(12) United States Patent
Freier

(10) Patent No.: US 7,951,934 B2
(45) Date of Patent: May 31, 2011

(54) COMPOSITIONS AND THEIR USES DIRECTED TO HUNTINGTIN

(75) Inventor: Susan M. Freier, San Diego, CA (US)

(73) Assignee: Isis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 11/627,916

(22) Filed: Jan. 26, 2007

(65) Prior Publication Data

US 2008/0039418 A1 Feb. 14, 2008

Related U.S. Application Data

(60) Provisional application No. 60/762,954, filed on Jan. 26, 2006, provisional application No. 60/836,290, filed on Aug. 7, 2006.

(51) Int. Cl.
C07H 21/04 (2006.01)
(52) U.S. Cl. .................. 536/24.5; 536/24.1; 536/24.31; 435/6; 435/325; 435/375; 514/44
(58) Field of Classification Search .................. None
See application file for complete search history.

(56) References Cited

U.S. PATENT DOCUMENTS

| | | | |
|---|---|---|---|
| 5,595,756 A | 1/1997 | Bally et al. | |
| 5,700,922 A | 12/1997 | Cook | |
| 5,801,154 A | 9/1998 | Baracchini et al. | |
| 5,998,148 A | 12/1999 | Bennett et al. | |
| 6,043,060 A | 3/2000 | Imanishi | |
| 6,147,200 A | 11/2000 | Manoharan et al. | |
| 6,582,908 B2 | 6/2003 | Fodor et al. | |
| 6,670,461 B1 | 12/2003 | Wengel et al. | |
| 7,320,965 B2 | 1/2008 | Sah et al. | |
| 2001/0053519 A1 | 12/2001 | Fodor et al. | |
| 2003/0109476 A1 | 6/2003 | Kmiec | |
| 2003/0228597 A1 | 12/2003 | Cowsert et al. | |
| 2004/0092465 A1* | 5/2004 | Dobie | 514/44 |
| 2004/0096880 A1 | 5/2004 | Kmiec | |
| 2004/0137471 A1 | 7/2004 | Vickers et al. | |
| 2005/0042646 A1 | 2/2005 | Davidson | |
| 2005/0096284 A1 | 5/2005 | McSwiggen | |
| 2005/0191638 A1 | 9/2005 | McSwiggen | |
| 2005/0255086 A1 | 11/2005 | Davidson | |
| 2005/0255487 A1* | 11/2005 | Khvorova et al. | 435/6 |
| 2007/0099860 A1 | 5/2007 | Sah | |

FOREIGN PATENT DOCUMENTS

| | | |
|---|---|---|
| WO | WO 94/26764 | 11/1994 |
| WO | WO 01/79283 | 10/2001 |
| WO | WO 03/064625 | 8/2003 |
| WO | WO 2004/048601 | 6/2004 |
| WO | WO 2005/027980 | 3/2005 |
| WO | WO 2005/045032 | 5/2005 |
| WO | WO 2005/105995 | 11/2005 |
| WO | WO 2005116204 A1 * | 12/2005 |

OTHER PUBLICATIONS

Vickers et al. (2003) J. Biol. Chem. 278:7108-7118.*

Boado et al., "Antisense-mediated down-regulation of the human huntington gene" *Journal of Pharmacology and Experimental Therapeutics* (2000) 295:239-243.

Borovecki et al., "Genome-wide expression profiling of human blood reveals biomarkers for Huntington's disease" *Proc. Natl. Acad. Sci. USA* (2005) 102:11023-11028.

Diaz-Hernandez et al., "Full Motor Recovery Despite Striatal Neuron Loss and Formation of Irreversible Amyloid-Like Inclusions in a Conditional Mouse Model of Huntington's Disease" *J. Neurosci* (2005) 25:9773-9781.

Gryaznov et al., "Oligodeoxyribonucleotide N3'->P5' Phosphoramidates Synthesis and Hybridization Properties" *J. Am. Chem. Soc.* (1994) 116:3143-3144.

Haque et al., "Antisense gene therapy for neurodegenerative disease" *Experimental Neurology* (1997) 144:139-146.

Harper et al., "RNA interference improves motor and neuropathological abnormalities in a Huntington's disease mouse model" *PNAS* (2005) 102:5820-5825.

Hasholt et al., "Antisense downregulation of mutant huntingtin in a cell model" *Journal of Gene Medicine* (2003) 5:528-538.

Hersch et al., "Translating Therapies for Huntington's Disease from Genetic Animal Models to Clinical Trials" *NeuroRX* (2004) 1:298-306.

Liu et al., "Specific inhibition of Huntington's disease gene expression by siRNAs in cultures cells" *Proceedings of the Japan Academy. Series B, Physical and Biological Sciences* (2003) 79B:293-298.

Machida et al., "rAAV-mediated shRNA ameliorated neuropathology in Huntington disease model mouse" *Biochem. Biophys. Res. Commun.* (2006) 343:190-197.

Maher et al., "Comparative hybrid arrest by tandem antisense oligodeoxyribonucleotides or oligodeoxyribonucleoside methylphosphonates in a cell-free system" *Nuc. Acid. Res.* (1988) 16:3341-3358.

Martin et al., "38. Ein neuer Zugang zu 2'-O-Alkylribonucleosiden and Eigenschaften deren Oligonucleotide" *Helv. Chim. Acta* (1995) 78:486-504.

Nellemann et al., "Inhibition of Hintington synthesis by antisense oligonucleotides" *Molecular and Cellular Neurosciences* (2000) 16:313-323.

Nguyen et al., "Clioquinol down-regulates mutant huntingtin expression in vitro and mitigates pathology in a Huntington's disease mouse model" *PNAS* (2005) 102:11840-11845.

Sheehan et al., "Biochemical properties of phosphonoacetate and thiophosphonoacetate oligodeoxyribonucleotides" *Nucleic Acids Research* (2003) 31:4109-4118.

(Continued)

*Primary Examiner* — Kimberly Chong
(74) *Attorney, Agent, or Firm* — Jones Day

(57) ABSTRACT

Disclosed herein are compounds, compositions and methods for modulating the expression of huntingtin in a cell, tissue or animal. Further provided are methods of slowing or preventing Huntington's disease progression using an antisense compound targeted to huntingtin. Additionally provided are methods of delaying or preventing the onset of Huntingtin's disease in an individual susceptible to Huntingtin's Disease. Also provided are uses of disclosed compounds and compositions in the manufacture of a medicament for treatment of diseases and disorders.

23 Claims, No Drawings

OTHER PUBLICATIONS

Uhlmann et al., "Antisense oligonucleotides: a new therapeutic principle" *Chemical Reviews* (1990) 90:543-584.
Wang et al., "Clinico-pathological rescue of a model mouse of Huntington's disease by siRNA" *Neurosci. Res.* (2005) 53:241-249.
Woolf et al., "Specificity of antisense oligonucleotides in vivo" *Proc. Natl. Acad. Sci. USA* (1992) 89:7305-7309.
International Search Report for Application # PCT/US2007/002215 dated Nov. 16, 2007.
International Search Report for Application # PCT/US2007/002171 dated Sep. 26, 2007.
Bennett et al. "Antisense oligonucleotides as a tool for gene functionalization and target validation" (1999) Biochimica Biophysica Acta 1489:19-30.
Chin, Andrew "On the Preparation and Utilization of Isolated and Purified Oligonucleotides." Document purportedly located on a CD-ROM and contributed to the public collection of the Katherine R. Everett Law Library of the University of North Carolina on Mar. 14, 2002.
Davidson et al. "Molecular medicine for the brain: silencing of disease genes with RNA interference" (2004) Lancet Neurol. 3:145-149.
Gonzalez-Alegre et al. "Technology Insight: therapeutic RNA interference—how far from the neurology clinic?" (2007) Nature Clinical Practice 3:394-404.
Harper et al. "Ten years of presymptomatic testing for Huntington's disease: the experience of the UK Huntington's Disease Prediction Consortium" (2000) J. Med. Genet. 37:567-571.
Macmillan et al. "Molecular analysis and clinical correlations of the Huntington's disease mutation" (1993) Lancet 342:954-958.
New England BioLabs, Inc. Catalogue (1998): 121, 284.
Reynolds et al., Rational siRNA design for RNA interference, Mar. 2004, Nature Biotechnology, vol. 22, pp. 326-330.
The Huntington's Disease Collaborative Research Group "A Novel Gene Containing a Trinucleotide Repeat That Is Expanded and Unstable on Huntington's Disease Chromosomes" (1993) Cell 72(6):971-983.
Branch et al., "A good antisense molecule is hard to find," TIBS (1998) 23:45-50.
Crooke et al., "Basic Principles of Antisense Therapeutics" Antisense Research and Application (1998) Chapter 1:1-50.
Hersch et al., "Neuroprotection for Huntington's disease: Ready, set, slow" Neurotherapeutics (2008) 5(2):226-236.
MacDonald et al., "A novel gene containing a trinucleotide repeat that is expanded and unstable on Huntington's disease chromosomes" Cell 72(6):971-983, 1993.
Sanghvi et al., "Heterocyclic Base Modifications in Nucleic Acids and Their Applications in Antisense Oligonucleotides" Antisense Research and Applications (1993) pp. 273-288.
Office Action from U.S. Appl. No. 11/627,921 dated Aug. 21, 2008.
Office Action from U.S. Appl. No. 11/627,921 dated Jun. 9, 2009.
Boffa et al., "Isolation of active genes containing CAG repeats by DNA strands invasion by a peptide nucleic acid" PNAS (1995) 92:1901-5.
Office Action from U.S. Appl. No. 12/618,470 dated Jan. 13, 2011.
International Search Report for Application # PCT/US2010/048532 dated Jan. 26, 2011.

* cited by examiner

COMPOSITIONS AND THEIR USES DIRECTED TO HUNTINGTIN

CROSS-REFERENCE TO RELATED APPLICATIONS

This Application claims priority under 35 U.S.C. 119 to U.S. Provisional Application Ser. No. 60/762,954, filed Jan. 26, 2006, titled "COMPOSITIONS AND THEIR USES DIRECTED TO HUNTINGTIN," and to U.S. Provisional Application Ser. No. 60/836,290, filed Aug. 7, 2006, titled "COMPOSITIONS AND THEIR USES DIRECTED TO HUNTINGTIN."

SEQUENCE LISTING

A computer-readable form of the sequence listing, named RTS0838USSEQ.txt, which is 560 kb and was created on Jan. 26, 2007, is herein incorporated by reference. GENBANK® numbers and their submission dates are also incorporated herein by reference.

BACKGROUND OF THE INVENTION

Huntington's disease (HD) is a neurodegenerative disorder caused by the mutation of the huntingtin gene. Alteration of this widely expressed single gene results in a progressive, neurodegenerative disorder with a large number of characteristic symptoms. Huntington's disease is an autosomal dominant disorder, with an onset generally in mid-life, although cases of onset from childhood to over 70 years of age have been documented. An earlier age of onset is associated with paternal inheritance, with 70% of juvenile cases being inherited through the father. Symptoms have an emotional, motor and cognitive component. Chorea is a characteristic feature of the motor disorder and is defined as excessive spontaneous movements which are irregularly timed, randomly distributed and abrupt. It can vary from being barely perceptible to severe. Other frequently observed abnormalities include dystonia, rigidity, bradykinesia, ocularmotor dysfunction and tremor. Voluntary movement disorders include fine motor incoordination, dysathria, and dysphagia. Emotional disorders commonly include depression and irritability, and cognitive component comprises subcortical dementia (Mangiarini et al., 1996. *Cell* 87:493-506). Changes in HD brains are widespread and include neuronal loss and gliosis, particularly in the cortex and striatum (Vonsattel and DiFiglia. 1998. *J. Neuropathol. Exp. Neurol.*, 57:369-384).

The HD mutation is a CAG expansion that results in the expansion of a poly-glutamine tract in the huntingtin protein, a 350 kDa protein of unknown function (Huntington Disease Collaborative Research Group, 1993. *Cell.* 72:971-83). The normal and expanded HD allele size have been found to be $CAG_{6-37}$ and $CAG_{35-121}$ repeats, respectively. Longer repeat sequences are associated with earlier disease onset. The mechanism by which the expansion results in pathology is unknown. However, the absence of an HD phenotype in individuals deleted for one copy of huntingtin, or increased severity of disease in those homozygous for the expansion suggests that the mutation does not result in a loss of function (Trottier et al., 1995, *Nature Med.*, 10:104-110). Transcriptional deregulation and loss of function of transcriptional coactivator proteins have been implicated in HD pathogenesis. Mutant huntingtin has been shown specifically to disrupt activator-dependent transcription in the early stages of HD pathogenesis (Dunah et al., 2002. *Science* 296:2238-2243). Gene profiling of human blood has identified 322 mRNAs that show significantly altered expression in HD blood samples as compared to normal or presymptomatic individuals. Expression of marker genes was similarly substantially altered in post-mortem brain samples from HD caudate, suggesting that upregulation of genes in blood samples reflects disease mechanisms found in brain. Monitoring of gene expression may provide a sensitive and quantitative method to monitor disease progression, especially in the early stages of disease in both animal models and human patients (Borovecki et al., 2005, *Proc. Natl. Acad. Sci. USA* 102: 11023-11028).

Identification of the gene has allowed for the development of animal models of the disease, including transgenic mice carrying mutated human or mouse forms of the gene. Models include mice carrying a fragment of the human gene, typically the first one or two exons, which contains the glutamine expansion, in addition to the undisrupted wild-type, endogenous, mouse gene; mice carrying the full length human huntingtin with an expanded glutamine repeat region, again with the endogenous mouse gene; and mice with pathogenic CAG repeats inserted into the CAG repeat region. All of the models have at least some shared features with the human disease. These mice have allowed for the testing of a number of different therapeutic agents for the prevention, amelioration and treatment of HD (see, e.g., Hersch and Ferrante, 2004. *NeuroRx.* 1:298-306) using a number of endpoints. The compounds are believed to function by a number of different mechanisms including transcription inhibition, caspace inhibition, histone deacetylase inhibition, antioxidant, huntingtin inhibition/antioxidant biogenergetic/antioxidant, antiexcitotoxic, and antiapoptotic.

A number of authors have reported that the repression of the mutant huntingtin transgene in animal models of HD reduces the symptoms associated with the disease, (see e.g. Diaz-Hernandez et al., (2005. *J. Neurosci.* 25:9773-81; incorporated herein by reference). Wang et al., (2005. *Nuerosci. Res.* 53:241-9; incorporated herein by reference) report that small interfering RNAs (siRNAs) directed against the huntingtin gene in the mouse model R6/2 inhibited transgenic huntingtin expression and significantly prolonged longevity, improved motor function and slowed loss of body weight.

Machida et al., (2006. *Biochem. Biophys. Res. Commun.* 343:190-7; incorporated herein by reference), report that recombinant adeno-associated virus (rAAV)-mediated delivery of RNA interference (RNAi) into the striatum of a HD mouse model ameliorated neuropathological abnormalities associated with HD, such as insoluable protein accumulation and down-regulation of DARPP-32 expression. Importantly, the authors state that neuronal aggregates in the striatum were reduced after RNAi transduction in the animals compared to those at the time point of RNAi transduction.

Harper et al., (2005. *PNAS* 102:5820-25; incorporated herein by reference), found that RNAi directed to huntingtin reduced huntingtin mRNA and protein expression in cell culture and a HD mouse model. The authors report that huntingtin gene silencing improved behavioral and neuropathological abnormalities associated with HD.

Rodrigues-Lebron et al., (2005. *Mol. Ther.* 12:618-33; incorporated herein by reference), report that a recombinant adeno-associated viral serotype 5 (rAAV5) gene transfer of RNAi to suppress the levels of striatal mutant huntingtin in the R6/1 HD transgenic mouse resulted in reduced levels of huntingtin mRNA and protein. The reduction in huntingtin was concomitant with a reduction in the size and number of neuronal intranuclear inclusions and other markers of HD, and resulted in delayed onset of the rear paw clasping phenotype exhibited by the R6/1 mice.

Nguyen et al., (2005. *PNAS,* 102:11840-45; incorporated herein by reference), used the metal-binding compound clioquinol to treat PC12 cells expressing the mutant huntingtin gene and found reduced accumulation of mutant protein. Treating the HD mouse model R6/2 with clioquinol resulted in improved behavioral and pathologic phenotypes, including decreased huntingtin aggregate accumulation, decreased striatal atrophy, improved rotarod performance, reduction of weight loss, normalization of blood glucose and insulin levels, and extension of lifespan, supporting the conclusion that reduction in mutant huntingtin protein is therapeutic for HD.

Based on these and other studies, one of skill in the art recognizes that reducing the expression of the mutant huntingtin gene will be therapeutic for HD.

SUMMARY OF THE INVENTION

One embodiment of the invention is an antisense oligonucleotide 12 to 35 nucleotides in length comprising at least 12 consecutive nucleotides of a nucleotide sequence selected from the group consisting of SEQ ID NOs 46-357. In a preferred embodiment, the nucleotide sequence is selected from the group consisting of SEQ ID NOs: 50, 93, 100, 105, 110, 125, 137, 345, 346, and 353. In a further embodiment, the antisense oligonucleotide has at least 95% or 100% complementarity to SEQ ID NO: 4. In a further embodiment, the antisense oligonucleotide has at least one modified internucleoside linkage, sugar moiety, or nucleobase. In a further embodiment, the antisense oligonucleotide comprises a chimeric oligonucleotide having a gap segment positioned between 5' and 3' wing segments, and in some embodiments, the gap segment of the chimeric oligonucleotide is comprised of 2'-deoxynucleotides and the wing segments are comprised of nucleotides having modified sugar moieties. Is still other embodiments, the modified sugar moiety is 2'-OMe or a bicyclic nucleic acid. In a preferred embodiment, the gap segment of the chimeric oligonucleotide consists of ten 2'-deoxynucleotides and each wing segment consists of five 2'-O-methoxyethyl-modified nucleotides, and in a more preferred embodiment said antisense oligonucleotide is 20 nucleotides in length.

In another embodiment each internucleoside linkage of the antisense oligonucleotide is a phosphorothioate internucleoside linkage.

In another embodiment each cytosine of the antisense oligonucleotide is a 5-methylcytosine.

In another embodiment, the antisense oligonucleotide is 17 to 25 nucleotides in length. In another embodiment, the antisense oligonucleotide is 19 to 23 nucleotides in length. In another embodiment the antisense oligonucleotide is 20 nucleotides in length.

Another embodiment of the invention is a pharmaceutical composition comprising any of the antisense oligonucleotide described herein and a pharmaceutically acceptable diluent.

Another embodiment is a method of treating an individual at risk of suffering from or currently suffering from Huntington's Disease (HD) comprising administering to the individual a therapeutically effective amount of a pharmaceutical composition comprising an antisense compound 12 to 35 nucleobases in length having at least 90% complementarity to nucleotides 1650-1704, 1807-1874, 3183-3228, 4010-4087, 4265-4288, 4553-4608, 5781-5820, and 6793-6796 of SEQ ID NO: 4, where the administration treats the individual. In a some embodiments, the administering comprises intrathecal delivery, intracerebroventricular delivery, or intraparenchymall delivery. In a some embodiments, the administering comprises administration into the cerebrospinal fluid of the individual by intrathecal infusion. In some embodiments, the treatment comprises improvement in one or more indicators of HD. In some embodiments, the treatment comprises increasing the survival time of the individual. In some embodiments, the treatment comprises delaying the onset of HD. In some embodiments, the antisense compound has at least at least 95%, or 100%, complementarity to nucleotides 1650-1704, 1807-1874, 3183-3228, 4010-4087, 4265-4288, 4553-4608, 5781-5820, and 6793-6796 of SEQ ID NO: 4.

In some embodiments, the antisense compound is an antisense oligonucleotide. In some embodiments, the antisense oligonucleotide has at least one modified internucleoside linkage, sugar moiety, or nucleobase. In some embodiments, the oligonucleotide comprises a chimeric oligonucleotide having a gap segment positioned between 5' and 3' wing segments. In some embodiments, the gap segment of the chimeric oligonucleotide is comprised of 2'-deoxynucleotides and the wing segments are comprised of nucleotides having modified sugar moieties. In some embodiments, the modified sugar moiety is 2'-OMe or a bicyclic nucleic acid. In some embodiments, the gap segment of the chimeric oligonucleotide consists of ten 2'-deoxynucleotides and each wing segment consists of five 2'-O-methoxyethyl-modified nucleotides. In some embodiments, each internucleoside linkage is a phosphorothioate internucleoside linkage. In some embodiments, each cytosine is a 5-methylcytosine. In some embodiments, the compound comprises 17 to 25 nucleotides, in others 19 to 23 nucleotides, in others, 20 nucleotides.

In some embodiments, the method further comprises selecting an individual suffering from HD. In some embodiments, the method further comprises selecting an individual susceptible to HD.

Another embodiment is a method of treating an individual at risk of suffering from or currently suffering from Huntington's Disease (HD) comprising administering to the individual a therapeutically effective amount of a pharmaceutical composition comprising an antisense oligonucleotide 12 to 35 nucleotides in length comprising at least 12 consecutive nucleotides of a nucleotide sequence selected from the group consisting of SEQ ID NOs 46-357. In some embodiments, the nucleotide sequence is selected from the group consisting of SEQ ID NOs: 50, 93, 100, 105, 110, 125, 137, 345, 346, and 353.

Another embodiment is the use of any of the antisense compounds or oligonucleotides disclosed herein in the manufacture of a medicament for treatment of HD. One embodiment is use of an antisense oligonucleotide 12 to 35 nucleotides in length comprising at least 12 consecutive nucleotides of a nucleotide sequence selected from the group consisting of SEQ ID NOs 46-357 in the preparation of a medicament for treating HD. Another embodiment is the use of an antisense oligonucleotide 12 to 35 nucleotides in length comprising at least 12 consecutive nucleotides of a nucleotide sequence selected from the group consisting of SEQ ID NOs: 50, 93, 100, 105, 110, 125, 137, 345, 346, and 353 in the preparation of a medicament for treating HD. In a further embodiment, the treatment of HD is the slowing of HD progression in an individual suffering from HD. In a further embodiment the treatment of HD is preventing the onset of HD in an individual susceptible to HD. In a further embodiment, the treatment of HD comprises increasing survival time of the individual.

DETAILED DESCRIPTION OF THE INVENTION

Overview

Huntington's disease is a progressive, neurodegenerative disease caused by mutation of a widely expressed, single gene, huntingtin. The mutation is an expansion of a CAG repeat region, wherein a larger expansion results in greater severity of the disease and an earlier age of onset. The mutation results in a variety of motor, emotional and cognitive symptoms, and results in the formation of huntingtin aggregates in brain. The absence of a phenotype for a single gene deletion, and an increase in disease severity in individuals carrying two mutated copies of the huntingtin gene suggests that the mutation does not result in a loss of function.

Antisense technology provides a mechanism for the development of therapeutic agents for a variety of diseases, including Huntinton's Disease. The principle behind antisense technology is that an antisense compound, which hybridizes to a target nucleic acid, modulates gene expression activities such as transcription or translation. This sequence specificity makes antisense compounds extremely attractive as tools for target validation and gene functionalization, as well as therapeutics to selectively modulate the expression of genes involved in disease.

The present invention is directed to antisense compounds, especially nucleic acid and nucleic acid-like oligomers, which are targeted to a nucleic acid encoding huntingtin, and which modulate the expression of huntingtin. In a preferred embodiment, the antisense compound is targeted to human huntingtin (SEQ ID NOs 1-5 and 45). Pharmaceutical and other compositions comprising the compounds of the invention are also provided. Further provided are methods of slowing HD progression, and methods of ameliorating or delaying the onset of HD symptoms. Such methods employ antisense compounds which modulate the expression of huntingtin.

Therapeutics

Provided herein are methods for treating an individual suffering from Huntington's Disease (HD). Treatment encompasses slowing of disease progression in an individual suffering from Huntington's Disease (HD) as well as delaying the onset of HD in an individual susceptible to HD. In some embodiments, such treatment methods comprise the administration to the cerebrospinal fluid of the individual a therapeutically effective amount of a pharmaceutical composition comprising an antisense compound or oligonucleotide targeted to huntingtin. Such treatment methods further comprise increasing the survival time of an individual suffering from HD, or increasing the survival time of an individual susceptible to HD. Slowing of disease progression is indicated by a lack of measurable change in, or an improvement of, one or more indicators of HD, including molecular markers or symptoms of the disease. The delaying of the onset of HD is indicated by a lack of clinical presentation of indicators of HD.

The present invention employs antisense compounds, particularly antisense oligonucleotides, for use in modulating the function of nucleic acid molecules encoding huntingtin, ultimately modulating the amount of huntingtin protein produced. A suitable form of modulation is inhibition of nucleic acid molecules encoding huntingtin, which is evidenced by a reduction in the levels of nucleic acids encoding huntingtin. Accordingly, disclosed herein are antisense compounds, including antisense oligonucleotides, for use in inhibiting the expression of nucleic acid molecules encoding huntingtin, i.e. reducing the levels of nucleic acid molecules encoding huntingtin. As used herein, the terms "target nucleic acid" and "nucleic acid molecule encoding huntingtin" have been used for convenience to encompass DNA encoding huntingtin, RNA (including pre-mRNA and mRNA or portions thereof) transcribed from such DNA, and also cDNA derived from such RNA. Antisense oligonucleotides which hybridize to and modulate the expression of one or more nucleic acids encoding huntingtin are considered to be "targeted to huntingtin." Antisense oligonucleotides of the present invention do not necessarily distinguish between wild-type huntingtin target nucleic acids and mutant huntingtin target nucleic acids. It is clinically desirable to reduce the levels of mutant huntingtin target nucleic acids, without introducing adverse effects due to reduction of the levels of wild-type huntingtin target nucleic acids.

In one embodiment, antisense oligonucleotides at least 90% complementary to exon 30 of SEQ ID NO: 4, which encompasses nucleotides 4010-4087 of SEQ ID NO: 4. Thus, antisense oligonucleotides are at least 90% complementary to nucleotides 4010-4087 of SEQ ID NO: 4. This embodiment includes antisense oligonucleotides comprising a sequence selected from SEQ ID NOs: 99, 100, 101, or 102.

In another embodiment, antisense oligonucleotides are at least 90% complementary to nucleotides 4028-4146 of SEQ ID NO: 4. In one embodiment, the antisense oligonucleotides include those comprising a sequence selected from SEQ ID NOs: 99, 100, 101, 102, or 103.

In another embodiment, antisense oligonucleotides are at least 90% complementary to nucleotides 4538-4615 of SEQ ID NO: 4. This embodiment includes antisense oligonucleotides comprising a sequence selected from SEQ ID NOs: 109, 110, 111, or 112.

In another embodiment, antisense oligonucleotides are at least 90% complementary to exon 34 of SEQ ID NO: 4, which encompasses nucleotides 4553-4608 of SEQ ID NO: 4. Thus, in this embodiment the antisense oligonucleotides are at least 90% complementary to nucleotides 4553-4608 of SEQ ID NO: 4. This embodiment includes antisense oligonucleotides comprising a sequence selected from SEQ ID NOs: 110 or 112.

In another embodiment, antisense oligonucleotides are at least 90% complementary to nucleotides 5781-5820 of SEQ ID NO: 4. In one embodiment, the antisense oligonucleotides comprise a sequence selected from SEQ ID NOs: 123, 124, or 125.

In another embodiment, antisense oligonucleotides are at least 90% complementary to exon 42 of SEQ ID NO: 4, which encompasses nucleotides 5722-5863 of SEQ ID NO: 4. Thus, in one embodiment, antisense oligonucleotides are at least 90% complementary to nucleotides 5722-5863 of SEQ ID NO: 4. In one embodiment, antisense oligonucleotides comprise a sequence selected from SEQ ID NOs: 123, 124, or 125.

In another embodiment, antisense oligonucleotides are at least 90% complementary to nucleotides 6763-6796 of SEQ ID NO: 4. In one embodiment, the antisense oligonucleotides comprise a sequence selected from SEQ ID NOs: 136, 137, or 138.

In another embodiment, antisense oligonucleotides are at least 90% complementary to a region comprising both exon 48 of SEQ ID NO: 4, which encompasses nucleotides 6560-6773 of SEQ ID NO: 4, and exon 49 of SEQ ID NO: 4, which encompasses nucleotides 6774-6919 of SEQ ID NO: 4. Accordingly, antisense oligonucleotides are at least 90% complementary to nucleotides 6560-6919 of SEQ ID NO: 4. In one embodiment, antisense oligonucleotides comprise a sequence selected from SEQ ID NOs: 134, 135, 136, 137, 138, or 151.

In another embodiment, antisense oligonucleotides are at least 90% complementary to nucleotides 3183-3253 of SEQ ID NO: 4. In one embodiment, antisense oligonucleotides comprise a sequence selected from SEQ ID NOs: 90, 91, 92, 93, and 94. In a further embodiment, antisense oligonucleotides are at least 90% complementary to nucleotides 3183-

3228 of SEQ ID NO: 4. This aspect encompasses antisense oligonucleotides comprising a sequence selected from SEQ ID NOs: 90, 91, 92, or 93.

In another embodiment, antisense oligonucleotides are at least 90% complementary to a region comprising both exon 23 of SEQ ID NO: 4, which encompasses nucleotides 3019-3211 of SEQ ID NO:4, and exon 24 of SEQ ID NO: 4, which encompasses nucleotides 3212-3288 of SEQ ID NO: 4. Thus, in one embodiment, antisense oligonucleotides are at least 90% complementary to nucleotides 3091-3288 of SEQ ID NO: 4. This embodiment encompasses antisense oligonucleotides comprising a sequence selected from SEQ ID NOs: 90, 91, 92, 93, or 94.

In another embodiment, antisense oligonucleotides are at least 90% complementary to nucleotides 4265-4288 of SEQ ID NO: 4. This embodiment encompasses antisense oligonucleotides comprising a sequence selected from SEQ ID NOs: 104 or 105.

In another embodiment, antisense oligonucleotides are at least 90% complementary to exon 31 of SEQ ID NO: 4, which encompasses nucleotides 4088-4311 of SEQ ID NO: 4. Thus, in this embodiment the antisense oligonucleotides are at least 90% complementary to nucleotides 4088-4311 of SEQ ID NO: 4. This embodiment encompasses the antisense oligonucleotides comprising a sequence selected from SEQ ID NOs: 103, 104, or 105.

In another embodiment, the antisense oligonucleotides are at least 90% complementary to nucleotides 1607-1704 of SEQ ID NO: 45. This embodiment encompasses antisense oligonucleotides comprising a sequence selected from SEQ ID NOs: 342, 343, 344, 345, 346, 347, 348, or 349. In one aspect, antisense oligonucleotides are at least 90% complementary to nucleotides 1650-1704 of SEQ ID NO: 45. This aspect encompasses antisense oligonucleotides comprising a sequence selected from SEQ ID NOs: 345, 346, 347, 348, or 349.

In another embodiment, antisense oligonucleotides are at least 90% complementary to nucleotides 1807-1874 of SEQ ID NO: 45. This embodiment encompasses antisense oligonucleotides comprising a sequence selected from SEQ ID NOs: 351, 352, 353, 354, 355, 356, or 357.

In another embodiment, antisense oligonucleotides are at least 90% complementary to nucleotides 985-1580 of SEQ ID NO: 45. This embodiment encompasses antisense oligonucleotides comprising a sequence selected from SEQ ID NOs: 329, 330, 331, 332, 333, 334, 335, 336, 337, 338, 339, 340, 341, 47, 48, 49, 50, 51, 52, 53, or 54.

In another embodiment, antisense oligonucleotides are at least 90% complementary to nucleotides 1079-1459 of SEQ ID NO: 45, which comprises a plurality of CAG repeats. This embodiment encompasses antisense oligonucleotides comprising a sequence selected from SEQ ID NOs: 48, 49, 50, 51, 52, or 53.

In another embodiment, antisense oligonucleotides are at least 90% complementary to nucleotides 1055-1477 of SEQ ID NO: 45. This region comprises a plurality of CAG repeats. This embodiment encompasses antisense oligonucleotides comprising a sequence selected from SEQ ID NOs: 338, 48, 49, 50, 51, 52, or 53.

In another embodiment, antisense oligonucleotides are at least 90% complementary to nucleotides 1019-1542 of SEQ ID NO: 45. This embodiment encompasses antisense oligonucleotides comprising a sequence selected from SEQ ID NOs: 331, 332, 333, 334, 335, 336, 337, 338, 339, 340, 341, 48, 49, 50, 51, 52, 53, or 54.

In further embodiments, antisense oligonucleotides are at least 95% complementary to a nucleotide region recited herein. In additional embodiments, antisense oligonucleotides are at least 96%, 97%, 98%, 99% or 100% complementary to a nucleotide region recited herein.

As used herein, an "individual suffering from Huntington's Disease (HD)" is an individual who has received from a health professional, such as a physician, a diagnosis of HD. Relevant diagnostic tests are well known in the art and are understood to include, without limitation, genetic testing to determine the presence of a mutation in the huntingtin gene, neurological examination, and brain imaging. Genetic testing for mutations in the huntingtin gene is a particularly accurate diagnostic test for the presence of HD.

An "individual susceptible to Huntington's Disease (HD)" is understood to include an individual who, based on genetic testing and/or family history, is likely to develop HD. Genetic testing for mutations in the huntingtin gene is a particularly accurate diagnostic test for susceptibility to HD. Indicators of HD may also be employed in the identification of an individual susceptible to HD.

In order for antisense inhibition of huntingtin to have a clinically desirable effect, it is beneficial to deliver an antisense oligonucleotide targeted to huntingtin to the central nervous system (CNS) of an individual, and in particular to the regions of the CNS affected by HD. As the blood-brain barrier is generally impermeable to antisense oligonucleotides administered systemically, a preferred method of providing antisense oligonucleotides targeted to huntingtin to the tissues of the CNS is via administration of the antisense oligonucleotides directly into the cerebrospinal fluid (CSF). Means of the delivery to the CSF and brain include intrathecal (IT), intracerebroventricular (ICV), and intraparenchymal administration. IT or ICV administration may be achieved through the use of surgically implanted pumps that infuse a therapeutic agent into the cerebrospinal fluid. Intraparenchymal delivery may be achieved by the surgical placement of a catheter into the brain. As used herein, "delivery to the CSF" and "administration to the CSF" encompass the IT infusion or ICV infusion of antisense oligonucleotides targeted to huntingtin through the use of an infusion pump. In some embodiments, IT infusion is a suitable means for delivery to the CSF. In other embodiments, the antisense oligonucleotide is continuously infused into the CSF for the entire course of treatment; such administration is referred to as "continuous infusion" or, in the case of IT infusion, "continuous IT infusion." Also contemplated is continuous intraparenchymal infusion using a pump.

In some embodiments, an infusion pump such as, for example, the Medtronic SyncroMed® II pump, is employed to deliver antisense oligonucleotides targeted to huntingtin to the CNS. The SyncroMed® II pump is surgically implanted according the procedures set forth by the manufacturer. The pump contains a reservoir for retaining a drug solution, which is pumped at a programmed dose into a catheter that is surgically implanted. For intrathecal administration of a drug, the catheter is surgically intrathecally implanted. In the context of the methods provided herein, the drug is the pharmaceutical composition comprising an antisense oligonucleotide targeted to huntingtin.

As used herein, a "pharmaceutical composition comprising an antisense oligonucleotide" refers to a composition comprising an antisense oligonucleotide targeted to huntingtin in a pharmaceutically acceptable diluent. By way of example, a suitable pharmaceutically acceptable diluent is phosphate-buffered saline. As provided herein, an ISIS Number represents the nonadecasodium salt of the antisense oligonucleotide having the provided nucleobase sequence, where nucleosides 1 to 5 and 16 to 20 have 2'-O-methoxyethyl sugar moieties, nucleosides 6 to 15 are 2'-deoxynucleotides, each internucleoside linkage is a phosphorothioate linkage, and each cytosine is a 5-methylcytosine.

As used herein, a "therapeutically effective amount" is an amount of a compound that provides a therapeutic benefit to an individual. For example, a therapeutically effective amount of an antisense compound targeted to huntingtin, such as an antisense oligonucleotide, is an amount that slows, or prevents the progression of HD, or prevents or delays the onset of HD. In one embodiment a therapeutically effective amount of an antisense oligonucleotide that will result in an improvement to, or prevents or slows the worsening of, one or more indicators or symptoms of HD, such as those described herein. In some embodiments, a therapeutically effective amount of an antisense oligonucleotide targeted to huntingtin ranges from 8 mg to 12 mg of antisense oligonucleotide. In other embodiments, a therapeutically effect amount of an antisense oligonucleotide targeted to huntingtin is 10 mg. As used herein, "treating" a patient with HD includes administering a therapeutically effective amount of a compound of the invention.

As used herein, "slowing disease progression" means the prevention of, or delay in, a clinically undesirable change in one or more clinical parameters in an individual suffering from HD, such as those described herein. It is well within the abilities of a physician to identify a slowing of disease progression in an individual suffering from HD, using one or more of the disease assessment tests described herein. Additionally, it is understood that a physician may administer to the individual diagnostic tests other than those described herein to assess the rate of disease progression in an individual suffering from HD.

As used herein, "delaying the onset of HD" means delaying undesirable changes in one or more indicators of HD that were previously negative for HD. A physician may use family history of HD to determine an approximate age of HD onset in an individual susceptible to HD to determine if onset of HD is delayed.

As used herein, "indicators of HD," are parameters employed by a medical professional, such as a physician, to diagnose or measure the progression of HD, and include, without limitation, genetic testing, hearing, eye movements, strength, coordination, chorea (rapid, jerky, involuntary movements), sensation, reflexes, balance, movement mental status, dementia, personality disorder, family history, weight loss, and degeneration of the caudate nucleus. Degeneration of the caudate nucleus is assessed via brain imaging techniques such as magnetic resonance imaging (MRI) or computed tomography (CT) scan.

As used herein, an "improvement in an indicator of HD" refers to the absence of an undesirable change, or the presence of a desirable change, in one or more indicators of HD. In one embodiment, an improvement in an indicator of HD is evidenced by the absence of a measurable change in one or more indicators of HD. In another embodiment, an improvement in an indicator of HD is evidenced by a desirable change in one or more indicators of HD.

A slowing of disease progression may further comprise an increase in survival time in an individual suffering from HD. An "increase in survival time" is understood to mean increasing the survival of an individual suffering from HD, relative to an approximate survival time based upon HD progression and/or family history of HD. A physician can use one or more of the disease assessment tests described herein to predict an approximate survival time of an individual suffering from HD. A physician may additionally use the family history of an individual suffering from HD to predict survival time.

Antisense compounds targeted to huntingtin can be used to modulate the expression of huntingtin in an animal, such as a human, including humans suffering from, or susceptible to, HD. In one embodiment, the antisense compounds effectively inhibit the levels or function of huntingtin RNA. Because reduction in huntingtin mRNA levels can lead to alteration in huntingtin protein products of expression as well, such resultant alterations can also be measured. Antisense compounds of the present invention that effectively inhibit the level or function of huntingtin RNA or protein products of expression are considered an active antisense compound. In one embodiment the antisense compounds of the invention inhibit the expression of huntingtin causing a reduction of RNA by at least 10%, by at least 20%, by at least 25%, by at least 30%, by at least 40%, by at least 50%, by at least 60%, by at least 70%, by at least 75%, by at least 80%, by at least 85%, by at least 90%, by at least 95%, by at least 98%, by at least 99%, or by 100%.

The reduction of the expression of huntingtin can be measured in a bodily fluid, tissue or organ of the animal. Methods of obtaining samples for analysis, such as body fluids or tissues, and methods of preparation of the samples to allow for analysis are well known to those skilled in the art. Methods for analysis of RNA and protein levels are discussed above and are well known to those skilled in the art. The effects of treatment using the compounds of the invention can be assessed by measuring biomarkers associated with the target gene expression in the aforementioned fluids, tissues or organs, collected from an animal contacted with one or more compounds of the invention, by routine clinical methods known in the art. Biomarkers of huntingtin include but are not limited to the accumulation of huntingtin positive neuronal inclusions, loss of certain neuronal tissue, etc.

In addition, a subject's systemic response to treatment can be assessed by monitoring clinically relevant measures that include but are not limited to: liver transaminases, bilirubin, albumin, blood urea nitrogen, creatine and other markers of kidney and liver function; interleukins, tumor necrosis factors, intracellular adhesion molecules, C-reactive protein and other markers of inflammation.

Methods whereby bodily fluids, organs or tissues are contacted with an effective amount of one or more of the antisense compounds or compositions of the invention are also contemplated. Bodily fluids, organs or tissues can be contacted with one or more of the compounds of the invention resulting in modulation of huntingtin expression in the cells of bodily fluids, organs or tissues. An effective amount can be determined by monitoring the modulatory effect of the antisense compound or compounds or compositions on target nucleic acids or their products by methods routine to the skilled artisan. Further contemplated are ex vivo methods of treatment whereby cells or tissues are isolated from a subject, contacted with an effective amount of the antisense compound or compounds or compositions and reintroduced into the subject by routine methods known to those skilled in the art.

In one embodiment provided are uses of a compound of an isolated double stranded RNA oligonucleotide in the manufacture of a medicament for inhibiting huntingtin expression or overexpression. Thus, provided herein is the use of an isolated double stranded RNA oligonucleotide targeted to huntingtin in the manufacture of a medicament for the treatment of a disease or disorder by means of the method described above.

Pharmaceutical Compositions

Antisense compounds targeted to huntingtin can be utilized in pharmaceutical compositions by adding an effective amount of a compound to a suitable pharmaceutically acceptable diluent or carrier. Acceptable carriers and diluents are well known to those skilled in the art. Selection of a diluent or carrier is based on a number of factors, including, but not limited to, the solubility of the compound and the route of administration. Such considerations are well understood by those skilled in the art. In one aspect, the antisense compounds of the present invention inhibit the expression of huntingtin.

Antisense compounds targeted to huntingtin can also be used in the manufacture of a medicament for the treatment of diseases and disorders related to huntingtin expression. In one embodiment, the disease or disorder is Huntinton's disease.

The antisense compounds of the present invention comprise any pharmaceutically acceptable salts, esters, or salts of such esters, or any other functional chemical equivalent which, upon administration to an animal including a human, is capable of providing (directly or indirectly) the biologically active metabolite or residue thereof. Accordingly, for example, the disclosure is also drawn to prodrugs and pharmaceutically acceptable salts of the oligomeric compounds of the present invention, pharmaceutically acceptable salts of such prodrugs, and other bioequivalents.

The term "prodrug" indicates a therapeutic agent that is prepared in an inactive or less active form that is converted to an active form (i.e., drug) within the body or cells thereof by the action of endogenous enzymes or other chemicals and/or conditions. In particular, prodrug versions of the oligonucleotides of the invention are prepared as SATE ((S-acetyl-2-thioethyl)phosphate) derivatives according to the methods disclosed in WO 93/24510 or WO 94/26764.

The term "pharmaceutically acceptable salts" refers to physiologically and pharmaceutically acceptable salts of the compounds of the invention: i.e., salts that retain the desired biological activity of the parent compound and do not impart undesired toxicological effects thereto. Sodium salts of antisense oligonucleotides are useful and are well accepted for therapeutic administration to humans. In another embodiment, sodium salts of dsRNA compounds are also provided.

Formulations

The oligomeric compounds of the invention may also be admixed, encapsulated, conjugated or otherwise associated with other molecules, molecule structures or mixtures of compounds, as for example, liposomes, receptor-targeted molecules, oral, rectal, topical or other formulations, for assisting in uptake, distribution and/or absorption. Representative United States patents that teach the preparation of such uptake, distribution and/or absorption-assisting formulations include, but are not limited to, U.S. Pat. Nos. 5,108,921; 5,354,844; 5,416,016; 5,459,127; 5,521,291; 5,543,158; 5,547,932; 5,583,020; 5,591,721; 4,426,330; 4,534,899; 5,013,556; 5,108,921; 5,213,804; 5,227,170; 5,264,221; 5,356,633; 5,395,619; 5,416,016; 5,417,978; 5,462,854; 5,469,854; 5,512,295; 5,527,528; 5,534,259; 5,543,152; 5,556,948; 5,580,575; and 5,595,756.

The present invention also includes pharmaceutical compositions and formulations which include the antisense compounds of the invention. The pharmaceutical compositions of the present invention may be administered in a number of ways depending upon whether local or systemic treatment is desired and upon the area to be treated. Administration may be topical (including but not limited to ophthalmic and to mucous membranes including vaginal and rectal delivery), pulmonary, e.g., by inhalation or insufflation of powders or aerosols, including by nebulizer (intratracheal, intranasal, epidermal and transdermal), oral or parenteral. Parenteral administration includes intravenous, intraarterial, subcutaneous, intraperitoneal or intramuscular injection or infusion; or intracranial, e.g., intrathecal or intraventricular, administration. Sites of administration are known to those skilled in the art. Oligonucleotides with at least one 2'-O-methoxyethyl modification are believed to be useful for oral administration.

The pharmaceutical formulations of the present invention, which may conveniently be presented in unit dosage form, may be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

In some embodiments, compositions for non-parenteral administration include one or more modifications from naturally-occurring oligonucleotides (i.e. full-phosphodiester deoxyribosyl or full-phosphodiester ribosyl oligonucleotides). Such modifications may increase binding affinity, nuclease stability, cell or tissue permeability, tissue distribution, or other biological or pharmacokinetic property.

Oral compositions for administration of non-parenteral oligomeric compounds can be formulated in various dosage forms such as, but not limited to, tablets, capsules, liquid syrups, soft gels, suppositories, and enemas. The term "alimentary delivery" encompasses e.g. oral, rectal, endoscopic and sublingual/buccal administration. Such oral oligomeric compound compositions can be referred to as "mucosal penetration enhancers."

Oligomeric compounds, such as oligonucleotides, may be delivered orally, in granular form including sprayed dried particles, or complexed to form micro or nanoparticles. Oligonucleotide complexing agents and their uses are further described in U.S. Pat. No. 6,287,860. Oral formulations for oligonucleotides and their preparation are described in detail in U.S. application Ser. Nos. 09/108,673 (filed Jul. 1, 1998), 09/315,298 (filed May 20, 1999) and 10/071,822, filed Feb. 8, 2002, which are herein incorporated by reference.

In one embodiment, oral oligomeric compound compositions comprise at least one member of the group consisting of surfactants, fatty acids, bile salts, chelating agents, and non-chelating surfactants. Such formulations are well known to those skilled in the art.

A "pharmaceutical carrier" or "excipient" can be a pharmaceutically acceptable solvent, suspending agent or any other pharmacologically inert vehicle for delivering one or more nucleic acids to an animal and are known in the art. The excipient may be liquid or solid and is selected, with the planned manner of administration in mind, so as to provide for the desired bulk, consistency, etc., when combined with a nucleic acid and the other components of a given pharmaceutical composition.

Oral oligomeric compositions may additionally contain other adjunct components conventionally found in pharmaceutical compositions, at their art-established usage levels.

One of skill in the art will recognize that formulations are routinely designed according to their intended route of administration.

Combinations

Compositions of the invention can contain two or more oligomeric compounds. In another related embodiment, compositions of the present invention can contain one or more antisense compounds, particularly oligonucleotides, targeted to a first nucleic acid and one or more additional antisense compounds targeted to a second nucleic acid target. Alternatively, compositions of the present invention can contain two or more antisense compounds targeted to different regions of the same nucleic acid target. Two or more combined compounds may be used together or sequentially.

Compounds

The term "oligomeric compound" refers to a polymeric structure capable of hybridizing to a region of a nucleic acid molecule. This term includes oligonucleotides, oligonucleosides, oligonucleotide analogs, oligonucleotide mimetics and chimeric combinations of these. Oligomeric compounds are routinely prepared linearly but can be joined or otherwise prepared to be circular. Moreover, branched structures are known in the art. An "antisense compound" or "antisense oligomeric compound" refers to an oligomeric compound that is at least partially complementary to the region of a nucleic acid molecule to which it hybridizes and which modulates (increases or decreases) its expression. Consequently, while all antisense compounds can be said to be oligomeric compounds, not all oligomeric compounds are antisense compounds. Nonlimiting examples of oligomeric compounds include primers, probes, antisense compounds, antisense oligonucleotides, external guide sequence (EGS) oligonucleotides, alternate splicers, and siRNAs. As such, these compounds can be introduced in the form of single-stranded, double-stranded, circular, branched or hairpins and can contain structural elements such as internal or terminal bulges or loops. Oligomeric double-stranded compounds can be two strands hybridized to form double-stranded compounds or a single strand with sufficient self complementarity to allow for hybridization and formation of a fully or partially double-stranded compound. The compounds of the instant invention are non-catalytic.

An "antisense oligonucleotide" is an antisense compound that is a nucleic acid-based oligomer, but does not include siRNA duplexes. In a preferred embodiment, and in any of the embodiments disclosed herein, the "antisense oligonucleotide" can be a single-stranded nucleic acid molecule. An antisense oligonucleotide can be chemically modified.

Antisense compounds comprise from about 12 to about 35 linked nucleotides. This embodies antisense compounds of 12, 13, 14, 15, 16, 17, 18, 19, 20, 21, 22, 23, 24, 25, 26, 27, 28, 29, 30, 31, 32, 33, 34, or 35 nucleotides in length.

In one embodiment, the antisense compounds are 15 to 30 linked nucleotides in length, as exemplified above.

In one embodiment, the antisense compounds are 17 to 25 linked nucleotides in length, as exemplified herein.

In one embodiment, the antisense compounds are 19, 20, 21, 22, 23, or 24 linked nucleotides in length, or alternatively the oligomeric compounds range from 19 to 24 linked nucleotides in length.

In one embodiment, the antisense compounds are 21, 22, 23, or 24 linked nucleotides in length, or alternatively the oligomeric compounds range from 21 to 24 linked nucleotides in length.

In one embodiment, the antisense compounds are 20 linked nucleotides in length.

In one embodiment of the invention, double-stranded antisense compounds encompass short interfering RNAs (siRNAs). As used herein, the term "siRNA" is defined as a double-stranded compound having a first and second strand, each strand having a central portion and two independent terminal portions. The central portion of the first strand is complementary to the central portion of the second strand, allowing hybridization of the strands. The terminal portions are independently, optionally complementary. The ends of the strands may be modified by the addition of one or more natural or modified nucleobases to form an overhang. In one nonlimiting example, the first strand of the siRNA is antisense to the target nucleic acid, while the second strand is complementary to the first strand. Once the antisense strand is designed to target a particular nucleic acid target the sense strand of the siRNA can then be designed and synthesized as the complement of the antisense strand and either strand may contain modifications or additions to either terminus. For example, in one embodiment, both strands of the siRNA duplex would be complementary over the central nucleobases, each having overhangs at one or both termini. It is possible for one end of a duplex to be blunt and the other to have overhanging nucleobases. In one embodiment, the number of overhanging nucleobases is from 1 to 6 on the 3' end of each strand of the duplex. In another embodiment, the number of overhanging nucleobases is from 1 to 6 on the 3' end of only one strand of the duplex. In a further embodiment the number of overhanging nucleobases is from 1 to 6 on one or both 5' ends of the duplexed strands. In another embodiment, the number of overhanging nucleobases is zero.

In one embodiment of the invention, double-stranded antisense compounds are canonical siRNAs. As used herein, the term "canonical siRNA" is defined as a double-stranded oligomeric compound having a first strand and a second strand each strand being 21 nucleobases in length with the strands being complementary over 19 nucleobases and having on each 3' termini of each strand a deoxy thymidine dimer (dTdT) which in the double-stranded compound acts as a 3' overhang.

Each strand of the siRNA duplex may be from about 12 to about 35 nucleobases. In a preferred embodiment, each strand of the siRNA duplex is about 17 to about 25 nucleobases. The central complementary portion may be from about 12 to about 35 nucleobases in length. In a preferred embodiment, the central complimentary portion is about 17 to about 25 nucleobases in length. It is understood that each the strand of the siRNA duplex and the central complementary portion may be about 12, 13, 14, 15, 16, 17, 18, 19, 20, 21, 22, 23, 24, 25, 26, 27, 28, 29, 30, 31, 32, 33, 34, or 35 nucleobases in length. The terminal portions can be from 1 to 6 nucleobases. It is understood that the terminal portions can be about 1, 2, 3, 4, 5, or 6 nucleobases in length. The siRNAs may also have no terminal portions. The two strands of an siRNA can be linked internally leaving free 3' or 5' termini, or can be linked to form a continuous hairpin structure or loop. The hairpin structure may contain an overhang on either the 5' or 3' terminus producing an extension of single-stranded character.

In another embodiment, the double-stranded antisense compounds are blunt-ended siRNAs. As used herein the term "blunt-ended siRNA" is defined as an siRNA having no terminal overhangs. That is, at least one end of the double-stranded compound is blunt. siRNAs, whether canonical or blunt, act to elicit dsRNAse enzymes and trigger the recruitment or activation of the RNAi antisense mechanism. In a further embodiment single-stranded RNAi (ssRNAi) compounds that act via the RNAi antisense mechanism are contemplated.

Further modifications can be made to the double-stranded compounds and may include conjugate groups attached to one of the termini, selected nucleobase positions, sugar positions or to one of the internucleoside linkages. Alternatively, the two strands can be linked via a non-nucleic acid moiety or linker group. When formed from only one strand, the compounds can take the form of a self-complementary hairpin-type molecule that doubles back on itself to form a duplex. Thus, the compounds can be fully or partially double-stranded. When formed from two strands, or a single strand that takes the form of a self-complementary hairpin-type molecule doubled back on itself to form a duplex, the two strands (or duplex-forming regions of a single strand) are complementary when they base pair in Watson-Crick fashion.

The antisense compounds in accordance with this invention may comprise a complementary antisense compound from about 12 to about 35 nucleobases (i.e. from about 12 to about 35 linked nucleosides). In other words, a single-stranded antisense compound of the invention comprises from about 12 to about 35 nucleobases, and a double-stranded antisense compound of the invention (such as a siRNA, for example) comprises two strands, each of which is from about 12 to about 35 nucleobases. Contained within the antisense compounds of the invention (whether single or double stranded and on at least one strand) are antisense portions. The "antisense portion" is that part of the antisense compound that is designed to work by one of the aforementioned antisense mechanisms. One of ordinary skill in the art will appreciate that this comprehends antisense portions of 12, 13, 14, 15, 16, 17, 18, 19, 20, 21, 22, 23, 24, 25, 26, 27, 28, 29, 30, 31, 32, 33, 34, or 35 nucleobases.

In one embodiment, the antisense compounds of the invention have antisense portions of 12 to 35 nucleobases. It is understood that the antisense portion may be about 12, 13, 14, 15, 16, 17, 18, 19, 20, 21, 22, 23, 24, 25, 26, 27, 28, 29, 30, 31, 32, 33, 34, or 35 nucleobases in length.

Antisense compounds 12 to 35 nucleobases in length comprising a stretch of at least 8, preferably at least 12, more preferably at least 17 consecutive nucleobases selected from within the illustrative antisense compounds are considered to be suitable antisense compounds as well. Also contemplated are antisense compounds 12 to 35 nucleobases in length comprising a stretch of at least 8, 9, 10, 11, 12, 13, 14, 15, 16, 17, 18, or 19 nucl nucleobases selected from within the illustrative antisense compounds are considered to be suitable antisense compounds as well.

Antisense compounds of the invention include antisense compound sequences that comprise at least the 8 (or 9-19) consecutive nucleobases from the 5'-terminus of one of the illustrative antisense compounds (the remaining nucleobases being a consecutive stretch of the same antisense beginning immediately upstream of the 5'-terminus of the antisense compound which is specifically hybridizable to the target nucleic acid and continuing until the antisense contains about 12 to 35 nucleobases). Other antisense compounds are represented by antisense compound sequences that comprise at least the 8 (or 9-19) consecutive nucleobases from the 3'-terminus of one of the illustrative antisense compounds (the remaining nucleobases being a consecutive stretch of the same oligonucleotide beginning immediately downstream of the 3'-terminus of the antisense compound which is specifically hybridizable to the target nucleic acid and continuing until the antisense compound contains about 12 to about 35 nucleobases). It is also understood that antisense compounds may be represented by antisense compound sequences that comprise at least 8 (or 9-19) consecutive nucleobases from an internal portion of the sequence of an illustrative compound, and may extend in either or both directions until the antisense contains about 12 to about 35 nucleobases.

One having skill in the art armed with the antisense compounds illustrated herein will be able, without undue experimentation, to identify further antisense compounds.

Chemical Modifications

As is known in the art, a nucleoside is a base-sugar combination. The base portion of the nucleoside is normally a heterocyclic base (sometimes referred to as a "nucleobase" or simply a "base"). The two most common classes of such heterocyclic bases are the purines and the pyrimidines. Nucleotides are nucleosides that further include a phosphate group covalently linked to the sugar portion of the nucleoside. For those nucleosides that include a pentofuranosyl sugar, the phosphate group can be linked to the 2', 3' or 5' hydroxyl moiety of the sugar. In forming oligonucleotides, the phosphate groups covalently link adjacent nucleosides to one another to form a linear polymeric compound. In turn, the respective ends of this linear polymeric compound can be further joined to form a circular compound. In addition, linear compounds may have internal nucleobase complementarity and may therefore fold in a manner as to produce a fully or partially double-stranded compound. Within oligonucleotides, the phosphate groups are commonly referred to as forming the internucleoside backbone of the oligonucleotide. The normal linkage or backbone of RNA and DNA is a 3' to 5' phosphodiester linkage.

Modified Internucleoside Linkages

Oligomeric compounds may comprise modified internucleoside linkages, e.g. non-naturally occurring internucleoside linkages. As defined in this specification, oligonucleotides having modified internucleoside linkages include internucleoside linkages that retain a phosphorus atom and internucleoside linkages that do not have a phosphorus atom. For the purposes of this specification, and as sometimes referenced in the art, modified oligonucleotides that do not have a phosphorus atom in their internucleoside backbone can also be considered to be oligonucleosides.

Oligomeric compounds, including antisense compounds and antisense oligonucleotides, can have one or more modified internucleoside linkages. Modified oligonucleotide backbones containing a phosphorus atom therein include, for example, phosphorothioates, chiral phosphorothioates, phosphorodithioates, phosphotriesters, aminoalkylphosphotriesters, methyl and other alkyl phosphonates including 3'-alkylene phosphonates, 5'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, phosphonoacetate and thiophosphonoacetate (see Sheehan et al., *Nucleic Acids Research*, 2003, 31(14), 4109-4118 and Dellinger et al., *J. Am. Chem. Soc.*, 2003, 125, 940-950), selenophosphates and boranophosphates having normal 3'-5' linkages, 2'-5' linked analogs of these, and those having inverted polarity wherein one or more internucleotide linkages is a 3' to 3', 5' to 5' or 2' to 2' linkage. Oligonucleotides having inverted polarity comprise a single 3' to 3' linkage at the 3'-most internucleotide linkage, i.e., a single inverted nucleoside residue which may be abasic (the nucleobase is missing or has a hydroxyl group in place thereof). Various salts, mixed salts and free acid forms are also included.

N3'-P5'-phosphoramidates have been reported to exhibit both a high affinity towards a complementary RNA strand and nuclease resistance (Gryaznov et al., *J. Am. Chem. Soc.*, 1994, 116, 3143-3144). N3'-P5'-phosphoramidates have been studied with some success in vivo to specifically down regulate the expression of the c-myc gene (Skorski et al., *Proc. Natl. Acad. Sci.*, 1997, 94, 3966-3971; and Faira et al., *Nat. Biotechnol.*, 2001, 19, 40-44).

In some embodiments, oligomeric compounds may have one or more phosphorothioate and/or heteroatom internucleoside linkages, in particular —$CH_2$—NH—O—$CH_2$—, —$CH_2$—N($CH_3$)—O—$CH_2$— (known as a methylene (methylimino) or MMI backbone), —$CH_2$—O—N($CH_3$)—$CH_2$—, —$CH_2$—N($CH_3$)—N($CH_3$)—$CH_2$— and —O—N($CH_3$)—$CH_2$—$CH_2$— (wherein the native phosphodiester internucleotide linkage is represented as —O—P(=O)(OH)—O—$CH_2$—).

Some oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; riboacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Modified Sugars

Oligomeric compounds may also contain one or more substituted sugar moieties. Suitable compounds can comprise one of the following at the 2' position: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Also suitable are $O((CH_2)_nO)_mCH_3$, $O(CH_2)_nOCH_3$, $O(CH_2)_nNH_2$, $O(CH_2)_nCH_3$, $O(CH_2)_nONH_2$, and $O(CH_2)_nON((CH_2)_nCH_3)_2$, where n and m are from 1 to about 10. Other oligonucleotides comprise one of the following at the 2' position: $C_1$ to $C_{10}$ lower alkyl, substituted lower alkyl, alkenyl, alkynyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. One modification includes 2'-methoxyethoxy (2'-O—$CH_2CH_2OCH_3$, also known as 2'-O-(2-methoxyethyl) or 2'-MOE) (Martin et al., *Helv. Chim. Acta*, 1995, 78, 486-504), i.e., an alkoxyalkoxy group. A further modification includes 2'-dimethylaminooxyethoxy, i.e., a $O(CH_2)_2ON(CH_3)_2$ group, also known as 2'-DMAOE, as described in examples hereinbelow, and 2'-dimethylaminoethoxyethoxy (also known in the art as 2'-O-dimethyl-amino-ethoxy-ethyl or 2'-DMAEOE), i.e., 2'-O—$(CH_2)_2$—O—$(CH_2)_2$—$N(CH_3)_2$, also described in examples hereinbelow.

Other modifications include 2'-methoxy (2'-O—$CH_3$), 2'-aminopropoxy (2'-$OCH_2CH_2CH_2NH_2$), 2'-allyl (2'-$CH_2$—CH=$CH_2$), 2'-O-allyl (2'-O—$CH_2$—CH=$CH_2$) and 2'-fluoro (2'-F). The 2'-modification may be in the arabino (up) position or ribo (down) position. One 2'-arabino modification is 2'-F. Similar modifications may also be made at other positions on the oligonucleotide, particularly the 3' position of the sugar on the 3' terminal nucleotide or in 2'-5' linked oligonucleotides and the 5' position of 5' terminal nucleotide. Antisense compounds may also have sugar mimetics such as cyclobutyl moieties in place of the pentofuranosyl sugar. Representative United States patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; 5,792,747; 5,700,920; and, 6,147,200.

A further modification includes bicyclic sugar moieties referred to as "bicyclic nucleic acids" or "BNAs" in which the 2'-hydroxyl group of the ribosyl sugar ring is linked to the 4' carbon atom of the sugar ring to form the bicyclic sugar moiety (reviewed in Elayadi et al., *Curr. Opinion Invens. Drugs,* 2001, 2, 558-561; Braasch et al., *Chem. Biol.,* 2001, 8 1-7; and Orum et al., *Curr. Opinion Mol. Ther.,* 2001, 3, 239-243; see also U.S. Pat. Nos. 6,268,490 and 6,670,461). The linkage can be a methylene (—$CH_2$—) group bridging the 2' oxygen atom and the 4' carbon atom, or can be an ethylene group. The alpha-L isomer of the bicyclic nucleic acid moiety wherein the linkage is a methylene group is an additional modified sugar moiety. Another bicyclic sugar moiety that has been prepared and studied has the bridge going from the 3'-hydroxyl group via a single methylene group to the 4' carbon atom of the sugar ring thereby forming a 3'-C,4'-C-oxymethylene linkage (see U.S. Pat. No. 6,043,060).

Oligonucleotide Mimetics

Another group of oligomeric compounds includes oligonucleotide mimetics. The term "mimetic" as it is applied to oligonucleotides includes oligomeric compounds wherein the furanose ring or the furanose ring and the internucleotide linkage are replaced with novel groups, replacement of only the furanose ring is also referred to in the art as being a sugar surrogate. The heterocyclic base moiety or a modified heterocyclic base moiety is maintained for hybridization with an appropriate target nucleic acid. Oligonucleotide mimetics include peptide nucleic acid (PNA) compounds (Nielsen et al., *Science,* 1991, 254, 1497-1500), morpholino-based compounds (see, for example, U.S. Pat. No. 5,034,506), cyclohexene nucleic acids (CeNA). In CeNA oligonucleotides (Wang et al., *J. Am. Chem. Soc.,* 2000, 122, 8595-8602), and phosphonomonoester nucleic acids.

Modified and Alternate Nucleobases

Oligomeric compounds can also include nucleobase (often referred to in the art as heterocyclic base or simply as "base") modifications or substitutions. As used herein, "unmodified" or "natural" nucleobases include the purine bases adenine (A) and guanine (G), and the pyrimidine bases thymine (T), cytosine (C) and uracil (U). A "substitution" is the replacement of an unmodified or natural base with another unmodified or natural base. "Modified" nucleobases mean other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl (—C≡C—$CH_3$) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine and 3-deazaguanine and 3-deazaadenine. Further modified nucleobases include tricyclic pyrimidines such as phenoxazine cytidine (1H-pyrimido(5,4-b)(1,4)benzoxazin-2(3H)-one), phenothiazine cytidine (1H-pyrimido(5,4-b)(1,4)benzothiazin-2(3H)-one),
G-clamps such as a substituted phenoxazine cytidine (e.g. 9-(2-aminoethoxy)-H-pyrimido(5,4-b)(1,4)benzoxazin-2 (3H)-one), carbazole cytidine (2H-pyrimido(4,5-b)indol-2-one), pyridoindole cytidine (H-pyrido(3',2':4,5)pyrrolo(2,3-d)pyrimidin-2-one). Modified nucleobases may also include those in which the purine or pyrimidine base is replaced with other heterocycles, for example 7-deaza-adenine, 7-deazaguanosine, 2-aminopyridine and 2-pyridone. Certain nucleobase modifications increase the binding affinity of the compounds of the invention. These include 5-substituted pyrimidines, 6-azapyrimidines and N-2, N-6 and O-6 substituted purines, including 2-aminopropyladenine, 5-propynyluracil and 5-propynylcytosine. 5-methylcytosine substitutions have been shown to increase nucleic acid duplex stability by 0.6-1.2° C. and are presently suitable base substitutions, even more particularly when combined with 2'-O-methoxyethyl sugar modifications. It is understood in the art that modification of the base does not entail such chemical modifications as to produce substitutions in a nucleic acid sequence.

Oligomeric compounds of the present invention can also include polycyclic heterocyclic compounds in place of one or more of the naturally-occurring heterocyclic base moieties. A number of tricyclic heterocyclic compounds have been previously reported. These compounds are routinely used in antisense applications to increase the binding properties of the modified strand to a target strand. The most studied modifications are targeted to guanosines hence they have been termed G-clamps or cytidine analogs.

Conjugates

Oligomeric compounds may be chemically linked to one or more moieties or conjugates which enhance the oligomeric compound properties such as activity, cellular distribution or cellular uptake. These moieties or conjugates can include conjugate groups covalently bound to functional groups such as primary or secondary hydroxyl groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Additional conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this invention, include groups that improve uptake, enhance resistance to degradation, and/or strengthen sequence-specific hybridization with the target nucleic acid. Groups that enhance the pharmacokinetic properties, in the context of this invention, include groups that improve uptake, distribution, metabolism or excretion of the compounds of the present invention.

Oligomeric compounds can also be modified to have one or more stabilizing groups that are generally attached to one or both termini of an oligomeric compound to enhance properties such as for example nuclease stability. Included in stabilizing groups are cap structures. By "cap structure or terminal cap moiety" is meant chemical modifications, which have been incorporated at either terminus of oligonucleotides. These terminal modifications protect the oligomeric compounds having terminal nucleic acid molecules from exonuclease degradation, and can improve delivery and/or localization within a cell. The cap can be present at either the 5'-terminus (5'-cap) or at the 3'-terminus (3'-cap) or can be present on both termini of a single strand, or one or more termini of both strands of a double-stranded compound. This cap structure is not to be confused with the inverted methylguanosine "5' cap" present at the 5' end of native mRNA molecules.

In non-limiting examples, the 5'-cap includes inverted abasic residue (moiety), 4',5'-methylene nucleotide; 1-(beta-D-erythrofuranosyl) nucleotide, 4'-thio nucleotide, carbocyclic nucleotide; 1,5-anhydrohexitol nucleotide; L-nucleotides; alpha-nucleotides; modified base nucleotide; phosphorodithioate linkage; threo-pentofuranosyl nucleotide; acyclic 3',4'-seco nucleotide; acyclic 3,4-dihydroxybutyl nucleotide; acyclic 3,5-dihydroxypentyl riucleotide, 3'-3'-inverted nucleotide moiety; 3'-3'-inverted abasic moiety; 3'-2'-inverted nucleotide moiety; 3'-2'-inverted abasic moiety; 1,4-butanediol phosphate; 3'-phosphoramidate; hexylphosphate; aminohexyl phosphate; 3'-phosphate; 3'-phosphorothioate; phosphorodithioate; or bridging or non-bridging methylphosphonate moiety. For siRNA constructs, the 5' end (5' cap) is commonly but not limited to 5'-hydroxyl or 5'-phosphate.

Particularly suitable 3'-cap structures include, for example 4',5'-methylene nucleotide; 1-(beta-D-erythrofuranosyl) nucleotide; 4'-thio nucleotide, carbocyclic nucleotide; 5'-amino-alkyl phosphate; 1,3-diamino-2-propyl phosphate, 3-aminopropyl phosphate; 6-aminohexyl phosphate; 1,2-aminododecyl phosphate; hydroxypropyl phosphate; 1,5-anhydrohexitol nucleotide; L-nucleotide; alpha-nucleotide; modified base nucleotide; phosphorodithioate; threo-pentofuranosyl nucleotide; acyclic 3',4'-seco nucleotide; 3,4-dihydroxybutyl nucleotide; 3,5-dihydroxypentyl nucleotide, 5'-5'-inverted nucleotide moiety; 5'-5'-inverted abasic moiety; 5'-phosphoramidate; 5'-phosphorothioate; 1,4-butanediol phosphate; 5'-amino; bridging and/or non-bridging 5'-phosphoramidate, phosphorothioate and/or phosphorodithioate, bridging or non bridging methylphosphonate and 5'-mercapto moieties (for more details see Beaucage and Tyer, 1993, Tetrahedron 49, 1925).

1. Chimeric Compounds

It is not necessary for all positions in a given oligomeric compound to be uniformly modified, and in fact more than one of the aforementioned modifications may be incorporated in a single compound or even within a single nucleoside within an oligomeric compound.

The present invention also includes oligomeric compounds which are chimeric compounds. "Chimeric" oligomeric compounds or "chimeras," in the context of this invention, are single- or double-stranded oligomeric compounds, such as oligonucleotides, which contain two or more chemically distinct regions, each comprising at least one monomer unit, i.e., a nucleotide in the case of an oligonucleotide compound. Chimeric antisense oligonucleotides are one form of oligomeric compound. These oligonucleotides typically contain at least one region which is modified so as to confer upon the oligonucleotide increased resistance to nuclease degradation, increased cellular uptake, alteration of charge, increased stability and/or increased binding affinity for the target nucleic acid. An additional region of the oligonucleotide may serve as a substrate for RNAses or other enzymes. By way of example, RNAse H is a cellular endonuclease which cleaves the RNA strand of an RNA:DNA duplex. Activation of RNase H, therefore, results in cleavage of the RNA target when bound by a DNA-like oligomeric compound, thereby greatly enhancing the efficiency of oligonucleotide-mediated inhibition of gene expression. The cleavage of RNA:RNA hybrids can, in like fashion, be accomplished through the actions of endoribonucleases, such as RNase III or RNAseL which cleaves both cellular and viral RNA. Cleavage products of the RNA target can be routinely detected by gel electrophoresis and, if necessary, associated nucleic acid hybridization techniques known in the art.

Chimeric oligomeric compounds of the invention can be formed as composite structures of two or more oligonucleotides, modified oligonucleotides, oligonucleosides, oligonucleotide mimetics, or regions or portions thereof. Such compounds have also been referred to in the art as hybrids or gapmers. Representative United States patents that teach the preparation of such hybrid structures include, but are not limited to, U.S. Pat. Nos. 5,013,830; 5,149,797; 5,220,007; 5,256,775; 5,366,878; 5,403,711; 5,491,133; 5,565,350; 5,623,065; 5,652,355; 5,652,356; and 5,700,922.

A "gapmer" is defined as an oligomeric compound, generally an oligonucleotide, having a 2'-deoxyoligonucleotide region flanked by non-deoxyoligonucleotide segments. The central region is referred to as the "gap." The flanking segments are referred to as "wings." While not wishing to be bound by theory, the gap of the gapmer presents a substrate recognizable by RNase H when bound to the RNA target whereas the wings do not provide such a substrate but can confer other properties such as contributing to duplex stability or advantageous pharmacokinetic effects. Each wing can be one or more non-deoxyoligonucleotide monomers (if one of the wings has zero non-deoxyoligonucleotide monomers, a "hemimer" is described). In one embodiment, the gapmer is a ten deoxynucleotide gap flanked by five non-deoxynucleotide wings. This is referred to as a 5-10-5 gapmer. Other configurations are readily recognized by those skilled in the art. In one embodiment the wings comprise 2'-MOE modified nucleotides. In another embodiment the gapmer has a phosphorothioate backbone. In another embodiment the gapmer has 2'-MOE wings and a phosphorothioate backbone. Other suitable modifications are readily recognizable by those skilled in the art.

Oligomer Synthesis

Oligomerization of modified and unmodified nucleosides can be routinely performed according to literature procedures for DNA (Protocols for Oligonucleotides and Analogs, Ed. Agrawal (1993), Humana Press) and/or RNA (Scaringe, Methods (2001), 23, 206-217. Gait et al., Applications of Chemically synthesized RNA in RNA: Protein Interactions, Ed. Smith (1998), 1-36. Gallo et al., Tetrahedron (2001), 57, 5707-5713).

Oligomeric compounds can be conveniently and routinely made through the well-known technique of solid phase synthesis. Equipment for such synthesis is sold by several vendors including, for example, Applied Biosystems (Foster City, Calif.). Any other means for such synthesis known in the art may additionally or alternatively be employed. It is well known to use similar techniques to prepare oligonucleotides such as the phosphorothioates and alkylated derivatives.

Oligonucleotide Synthesis

Oligomeric compounds and phosphoramidites are made by methods well known to those skilled in the art. Oligomerization of modified and unmodified nucleosides is performed according to literature procedures for DNA like compounds (Protocols for Oligonucleotides and Analogs, Ed. Agrawal (1993), Humana Press) and/or RNA like compounds (Scaringe, Methods (2001), 23, 206-217. Gait et al., Applications of Chemically synthesized RNA in RNA:Protein Interactions, Ed. Smith (1998), 1-36. Gallo et al., Tetrahedron (2001), 57, 5707-5713) synthesis as appropriate. Alternatively, oligomers may be purchased from various oligonucleotide synthesis companies such as, for example, Dharmacon Research Inc., (Lafayette, Colo.).

Irrespective of the particular protocol used, the oligomeric compounds used in accordance with this invention may be conveniently and routinely made through the well-known technique of solid phase synthesis. Equipment for such synthesis is sold by several vendors including, for example, Applied Biosystems (Foster City, Calif.). Any other means for such synthesis known in the art may additionally or alternatively be employed (including solution phase synthesis).

Methods of isolation and analysis of oligonucleotides are well known in the art. A 96-well plate format is particularly useful for the synthesis, isolation and analysis of oligonucleotides for small scale applications.

Hybridization

"Hybridization" means the pairing of complementary strands of oligomeric compounds. While not limited to a particular mechanism, the most common mechanism of pairing involves hydrogen bonding, which may be Watson-Crick, Hoogsteen or reversed Hoogsteen hydrogen bonding, between complementary nucleoside or nucleotide bases (nucleobases) of the strands of oligomeric compounds. For example, adenine and thymine are complementary nucleobases which pair through the formation of hydrogen bonds. Hybridization can occur under varying circumstances.

An oligomeric compound is specifically hybridizable when there is a sufficient degree of complementarity to avoid non-specific binding of the oligomeric compound to non-target nucleic acid sequences under conditions in which specific binding is desired, i.e., under physiological conditions in the case of in vivo assays or therapeutic treatment, and under conditions in which assays are performed in the case of in vitro assays.

"Stringent hybridization conditions" or "stringent conditions" refer to conditions under which an oligomeric compound will hybridize to its target sequence, but to a minimal number of other sequences. Stringent conditions are sequence-dependent and will be different in different circumstances, and "stringent conditions" under which oligomeric compounds hybridize to a target sequence are determined by the nature and composition of the oligomeric compounds and the assays in which they are being investigated.

Complementarity

"Complementarity," as used herein, refers to the capacity for precise pairing between two nucleobases on one or two oligomeric compound strands. For example, if a nucleobase at a certain position of an antisense compound is capable of hydrogen bonding with a nucleobase at a certain position of a target nucleic acid, then the position of hydrogen bonding between the oligonucleotide and the target nucleic acid is considered to be a complementary position. The oligomeric compound and the further DNA or RNA are complementary to each other when a sufficient number of complementary positions in each molecule are occupied by nucleobases which can hydrogen bond with each other. Thus, "specifically hybridizable" and "complementary" are terms which are used to indicate a sufficient degree of precise pairing or complementarity over a sufficient number of nucleobases such that stable and specific binding occurs between the oligomeric compound and a target nucleic acid.

As used herein, an antisense oligonucleotide is "fully complementary" to a target nucleic acid when each nucleobase of the antisense oligonucleotide is capable of undergoing precise base pairing with an equal number of nucleobases in the target nucleic acid. It is understood in the art that the sequence of the antisense oligonucleotide need not be fully complementary to that of its target nucleic acid to be active in inhibiting the activity of the target nucleic acid. In some embodiments there are "non-complementary" positions, also known as "mismatches", between the antisense oligonucleotide and the target nucleic acid, and such non-complementary positions may be tolerated between an antisense oligonucleotide and the target nucleic acid provided that the antisense oligonucleotide remains specifically hybridizable to the target nucleic acid. For example, as demonstrated herein, 387916, having one non-complementary nucleobases with respect to mouse huntingtin, is capable of reducing mouse huntingtin mRNA levels in vitro and in vivo. A "non-complementary nucleobase" means a nucleobase of an antisense oligonucleotide that is unable to undergo precise base pairing with a nucleobase at a corresponding position in a target nucleic acid. As used herein, the terms "non-complementary" and "mismatch" are interchangeable. In some embodiments antisense oligonucleotides having no more than three non-complementary nucleobases with respect to a nucleic acid encoding huntingtin are considered "complementary" to a nucleic acid encoding huntingtin. In other embodiments, antisense oligonucleotides contain no more than two non-complementary nucleobases with respect to a nucleic acid encoding huntingtin. In further embodiments, antisense oligonucleotides contain no more than one non-complementary nucleobase with respect to a nucleic acid encoding huntingtin.

The location of a non-complementary nucleobase may be at the 5' end or 3' end of the antisense oligonucleotide. Alternatively, the non-complementary nucleobase may be at an internal position in the antisense oligonucleotide. When two or more non-complementary nucleobases are present, they may be contiguous (i.e. linked) or non-contiguous.

In other embodiments of the invention, the antisense oligonucleotides comprise at least 90% sequence complementarity to a huntingtin target nucleic acid. In further embodiments of the invention, the antisense oligonucleotides comprise at least 95% sequence complementarity to a huntingtin target nucleic acid. In further embodiments of the invention, the antisense oligonucleotides comprise at least 96%, 97%, 98% or 99% sequence complementarity to a huntingtin target nucleic acid.

Examples of oligonucleotides having mismatches or less than 100% sequence complementarity are shown in Table 1 below where the mismatch is designated by the letter X in the sequence.

TABLE 1

| Isis No. | SEQ ID NO: | Sequence (5' to 3') | X is |
|---|---|---|---|
| 387902 | 105 | CGCCTGCACCATGTTCCTCA | |
| | 358 | CGXCTGCACCATGTTCCTCA | A or T |
| | 359 | CGCCXGCACCATGTTCCTCA | C or G |
| | 360 | CGCCTGCACCAXGTTCCTCA | C or G |
| | 361 | CGCCTGCACCATGTTCXTCA | A or T |
| 388816 | 345 | GCCGTAGCCTGGGACCCGCC | |
| | 362 | GCXGTAGCCTGGGACCCGCC | A or T |
| | 363 | GCCGTAGCXTGGGXCCCGCC | C or G |
| | 364 | GCCGTAGCCTGGGACCCXCC | A or T |
| | 365 | GCCGTAGCCTGGGACCCGCX | A or T |
| 387916 | 125 | TCTCTATTGCACATTCCAAG | |
| | 366 | TCXCTATTGCACATTCCAAG | C or G |
| | 367 | TCTCTATXGCACATTCCAAG | C or G |
| | 368 | TCTCTATTGCAXATTCCAAG | A or T |
| | 369 | TCTCTATTGCACATTCXAAG | A or T |

Identity

Oligomeric compounds, or a portion thereof, may have a defined percent identity to a SEQ ID NO, or a compound having a specific Isis number. This identity may be over the entire length of the oligomeric compound, or in a portion of the oligomeric compound (e.g., nucleobases 1-20 of a 27-mer may be compared to a 20-mer to determine percent identity of the oligomeric compound to the SEQ ID NO.). It is understood by those skilled in the art that an oligonucleotide need not have an identical sequence to those described herein to function similarly to the oligonucleotides described herein. Shortened (i.e., deleted, and therefore non-identical) versions of oligonucleotides taught herein, or non-identical (i.e., one base replaced with another) versions of the oligonucleotides taught herein fall within the scope of the invention. Percent identity is calculated according to the number of bases that are identical to the SEQ ID NO or compound to which it is being compared. The non-identical bases may be adjacent to each other, dispersed through out the oligonucleotide, or both.

For example, a 16-mer having the same sequence as nucleobases 2-17 of a 20-mer is 80% identical to the 20-mer. Alternatively, a 20-mer containing four nucleobases not identical to the 20-mer is also 80% identical to the 20-mer. A 14-mer having the same sequence as nucleobases 1-14 of an 18-mer is 78% identical to the 18-mer. Such calculations are well within the ability of those skilled in the art.

The percent identity is based on the percent of nucleobases in the original sequence present in a portion of the modified sequence. Therefore, a 30 nucleobase oligonucleotide comprising the full sequence of a 20 nucleobase SEQ ID NO would have a portion of 100% identity with the 20 nucleobase SEQ ID NO while further comprising an additional 10 nucleobase portion. In the context of the invention, the full length of the modified sequence may constitute a single portion.

It is well known by those skilled in the art that it is possible to increase or decrease the length of an antisense oligonucleotide and/or introduce mismatch bases without eliminating activity. For example, in Woolf et al. (Proc. Natl. Acad. Sci. USA 89:7305-7309. 1992, incorporated herein by reference), a series of oligomers 13-25 nucleobases in length were tested for their ability to induce cleavage of a target RNA in an oocyte injection model. Oligonucleotides 25 nucleobases in length with 8 or 11 mismatch bases near the ends of the oligonucleotide were able to direct specific cleavage of the target mRNA, albeit to a lesser extent than the oligonucleotide that contained no mismatches. Similarly, target specific cleavage was achieved using a 13 nucleobase oligomer, including those with 1 or 3 mismatches. Maher and Dolnick (Nuc. Acid. Res. 16:3341-3358.1988, incorporated herein by reference) tested a series of tandem 14 nucleobase oligonucleotides, and a 28 and 42 nucleobase oligonucleotide comprised of the sequence of two or three of the tandem oligonucleotides, respectively, for their ability to arrest translation of human DHFR in a rabbit reticulocyte assay. Each of the three 14 nucleobase oligonucleotides alone were able to inhibit translation, albeit at a more modest level, than the 28 or 42 nucleobase oligonucleotide. Interestingly, a mixture of the tandem 14 nucleobase oligonucleotides was as effective at inhibiting translation as the 28 nucleobase oligonucleotide targeted to the same region.

Target Nucleic Acids

"Targeting" an oligomeric compound to a particular target nucleic acid molecule can be a multistep process. The process usually begins with the identification of a target nucleic acid whose expression is to be modulated. As used herein, the terms "target nucleic acid" and "nucleic acid encoding huntingtin" encompass DNA encoding huntingtin, RNA (including pre-mRNA and mRNA) transcribed from such DNA, and also cDNA derived from such RNA. For example, the target nucleic acid can be a cellular gene (or mRNA transcribed from the gene) whose expression is associated with a particular disorder or disease state, or a nucleic acid molecule from an infectious agent. As disclosed herein, the target nucleic acid encodes huntingtin.

2. Target Regions, Segments, and Sites

The targeting process usually also includes determination of at least one target region, segment, or site within the target nucleic acid for the antisense interaction to occur such that the desired effect, e.g., modulation of expression, will result. "Region" is defined as a portion of the target nucleic acid having at least one identifiable structure, function, or characteristic. Target regions include, but are not limited to, contiguous nucleotide sequences, translation initiation and termination regions, coding regions, open reading frames, introns, exons, 3'-untranslated regions (3'-UTR), and 5'-untranslated regions (5'-UTR). Within regions of target nucleic acids are target segments. As used herein, a "target segment" means a sequence of a huntingtin target nucleic acid to which one or more antisense oligonucleotides are complementary. The term "5' target site" is defined as the 5'-most nucleobase of a target segment to which an antisense oligonucleotide is complementary. Likewise, a "3' target site" is defined as the 3'-most nucleobase of a target segment to which an antisense oligonucleotide is complementary.

3. Variants

It is also known in the art that alternative RNA transcripts can be produced from the same genomic region of DNA. These alternative transcripts are generally known as "variants." More specifically, "pre-mRNA variants" are transcripts produced from the same genomic DNA that differ from other transcripts produced from the same genomic DNA in either their start or stop position and contain both intronic and exonic sequence. Variants can result in mRNA variants including, but not limited to, those with alternate splice junctions, or alternate initiation and termination codons. Variants in genomic and mRNA sequences can result in disease. Oligonucleotides to such variants are within the scope of the instant invention.

4. Target Names and Synonyms

In accordance with the present invention are compositions and methods for modulating the expression of genes which are presented in Table 2. Listed in Table 2 are the gene target names, as well as GENBANK® accession numbers used to design oligomeric compounds targeted to each gene.

TABLE 2

Gene Target Names and Sequences

| Species | Genbank # | SEQ ID NO |
|---|---|---|
| Human | AB209506.1 | 1 |
| Human | BE378835.1 | 2 |
| Human | L12392.1 | 3 |
| Human | NM_002111.5 | 4 |
| Human | nucleotides 462000 to 634000 of NT_006081.17 | 5 |
| Mouse | AK042204.1 | 6 |
| Mouse | AK049546.1 | 7 |
| Mouse | L23312.1 | 8 |
| Mouse | L23313.1 | 9 |
| Mouse | NM_010414.1 | 10 |
| Mouse | nucleotides 2036000 to 2190000 of NT_039302.4 | 11 |
| Mouse | NM_010414.1 (mouse short form) * | 44 |

TABLE 2-continued

Gene Target Names and Sequences

| Species | Genbank # | SEQ ID NO |
|---|---|---|
| Human | cut from genomic ad Sac1 and EcoR1 sites surrounding exon 1, expanded CAG to results in 130 gln in this region | 45 |

* NM_010414.1 (mouse short form) extended with mouse genomic sequence to create transcript orthologous to human long form (NM_002111.5). Much of this extension is supported by mouse ESTs but the most 3' end is supported only by homology to the human mRNA Modulation of Target Expression Modulation of expression of a target nucleic acid can be achieved through alteration of any number of nucleic acid (DNA or RNA) functions. "Modulation" means a perturbation of function, for example, either an increase (stimulation or induction) or a decrease (inhibition or reduction) in expression. As another example, modulation of expression can include perturbing splice site selection of pre-mRNA processing. "Expression" includes all the functions by which a gene's coded information is converted into structures present and operating in a cell. These structures include the products of transcription and translation. "Modulation of expression" means the perturbation of such functions. The functions of DNA to be modulated can include replication and transcription. Replication and transcription, for example, can be from an endogenous cellular template, a vector, a plasmid construct or otherwise. The functions of RNA to be modulated can include translocation functions, which include, but are not limited to, translocation of the RNA to a site of protein translation, translocation of the RNA to sites within the cell which are distant from the site of RNA synthesis, and translation of protein from the RNA. RNA processing functions that can be modulated include, but are not limited to, splicing of the RNA to yield one or more RNA species, capping of the RNA, 3' maturation of the RNA and catalytic activity or complex formation involving the RNA which may be engaged in or facilitated by the RNA. Modulation of expression can result in the increased level of one or more nucleic acid species or the decreased level of one or more nucleic acid species, either temporally or by net steady state level. One result of such interference with target nucleic acid function is modulation of the expression of HUNTINGTINα. Thus, in one embodiment modulation of expression can mean increase or decrease in target RNA or protein levels. In another embodiment modulation of expression can mean an increase or decrease of one or more RNA splice products, or a change in the ratio of two or more splice products.

Cultured Cells

The effect of oligomeric compounds of the present invention on target nucleic acid expression can be tested in any of a variety of cell types provided that the target nucleic acid is present at measurable levels. The effect of oligomeric compounds of the present invention on target nucleic acid expression can be routinely determined using, for example, PCR or Northern blot analysis. Cell lines are derived from both normal tissues and cell types and from cells associated with various disorders (e.g. hyperproliferative disorders). Cell lines derived from multiple tissues and species can be obtained from American Type Culture Collection (ATCC, Manassas, Va.) and are well known to those skilled in the art. Primary cells, or those cells which are isolated from an animal and not subjected to continuous culture, can be prepared according to methods known in the art or obtained from various commercial suppliers. Additionally, primary cells include those obtained from donor human subjects in a clinical setting (i.e. blood donors, surgical patients).

Cells isolated from Huntington's disease patients are also used to test the effects of antisense compounds targeted to huntingtin. In such cells, the mutant huntingtin gene may be present in a heterozygous or homozygous form. Such cells are available from National Institute of General Medical Sciences (NIGMS) Human Genetic Cell Repository, examples of which include fibroblasts having repository number GMO4281 or GMO4478. Cells from Huntington's disease patients are cultured according to procedures recommended by the supplier.

The pharmacological effects of antisense inhibition of huntingtin can be assessed in cell lines isolated from neuronal cells expressing either wild-type or mutant forms of the huntingtin gene. The mutant forms of huntingtin are associated with particular phenotypes, and the effects on these phenotypes are evaluated following antisense inhibition of huntintin. An example of such cells are striatal cells established from Hdh$^{Q111}$ knock-in mice, which bear 111 CAG repeats inserted into the mouse huntingtin locus. Establishment of striatal cell lines isolated from Hdh$^{Q111}$ mice has been described by Trettel et al. (Human Mol. Genet., 2000, 9, 2799-2809). Striatal cell lines established from mice bearing a wild-type huntingtin gene are used for comparison studies.

Assaying Modulation of Expression

Modulation of huntingtin expression can be assayed in a variety of ways known in the art. Huntingtin mRNA levels can be quantitated by, e.g., Northern blot analysis, competitive polymerase chain reaction (PCR), or real-time PCR. RNA analysis can be performed on total cellular RNA or poly(A)+ mRNA by methods known in the art. Methods of RNA isolation are taught in, for example, Ausubel, F. M. et al., *Current Protocols in Molecular Biology*, Volume 1, pp. 4.1.1-4.2.9 and 4.5.1-4.5.3, John Wiley & Sons, Inc., 1993.

Northern blot analysis is routine in the art and is taught in, for example, Ausubel, F. M. et al., *Current Protocols in Molecular Biology*, Volume 1, pp. 4.2.1-4.2.9, John Wiley & Sons, Inc., 1996. Real-time quantitative (PCR) can be conveniently accomplished using the commercially available ABI PRISM™ 7700 Sequence Detection System, available from PE-Applied Biosystems, Foster City, Calif. and used according to manufacturer's instructions. The method of analysis of modulation of RNA levels is not a limitation of the instant invention.

Levels of a protein encoded by huntingtin can be quantitated in a variety of ways well known in the art, such as immunoprecipitation, Western blot analysis (immunoblotting), ELISA or fluorescence-activated cell sorting (FACS). Antibodies directed to a protein encoded by huntingtin can be identified and obtained from a variety of sources, such as the MSRS catalog of antibodies (Aerie Corporation, Birmingham, Mich.).

Validated Target Segments

The locations on the target nucleic acid to which active oligomeric compounds hybridize are hereinbelow referred to as "validated target segments." In one embodiment, a validated target segment includes at least an 8-nucleobase portion of a target region. In another embodiment, a validated target segment includes at least a 12-nucleobase portion of a target region to which an active oligomeric compound is targeted. While not wishing to be bound by theory, it is presently believed that these target segments represent portions of the target nucleic acid which are accessible for hybridization.

Target segments can include DNA or RNA sequences that comprise at least the 8, or at least the 12, consecutive nucleobases from the 5'-terminus of a validated target segment (the remaining nucleobases being a consecutive stretch of the same DNA or RNA beginning immediately upstream of the 5'-terminus of the target segment and continuing until the DNA or RNA contains about 12 to about 35 nucleobases). Similarly validated target segments are represented by DNA or RNA sequences that comprise at least the 8, or at least the 12 consecutive nucleobases from the 3'-terminus of a validated target segment (the remaining nucleobases being a consecutive stretch of the same DNA or RNA beginning immediately downstream of the 3'-terminus of the target segment and continuing until the DNA or RNA contains about 12 to about 35 nucleobases). It is also understood that a validated oligomeric target segment can be represented by DNA or RNA sequences that comprise at least 8, or at least the 12, consecutive nucleobases from an internal portion of the sequence of a validated target segment, and can extend in either or both directions until the oligonucleotide contains about 12 to about 35 nucleobases.

Screening for Modulator Compounds

In another embodiment the validated target segments identified herein can be employed in a screen for additional compounds that modulate the expression of huntingtin. "Modulators" are those compounds that modulate the expression of huntingtin and which comprise at least an 8-nucleobase portion which is complementary to a validated target segment. The screening method comprises the steps of contacting a validated target segment of a nucleic acid molecule encoding huntingtin with one or more candidate modulators, and selecting for one or more candidate modulators which perturb the expression of a nucleic acid molecule encoding huntingtin. Once it is shown that the candidate modulator or modulators are capable of modulating the expression of a nucleic acid molecule encoding huntingtin, the modulator can then be employed in further investigative studies of the function of huntingtin, or for use as a research, diagnostic, or therapeutic agent. The validated target segments can also be combined with a second strand as disclosed herein to form stabilized double-stranded (duplexed) oligonucleotides for use as a research, diagnostic, or therapeutic agent.

In Vivo Testing of Antisense Compounds Targeted to Huntingtin

Antisense compounds targeted to huntingtin are tested in experimental animal models. In one embodiment, the antisense compounds are targeted to the human hungtingtin gene alone. Such antisense compounds have, for example, less than four mismatches to human huntingtin and four or more mismatches to non-human huntingtin. In another embodiment, antisense compounds are targeted to both human and non-human huntingtin. Such antisense compounds have, for example, less than four mismatches to human huntingtin and less than four mismatches to non-human huntingtin.

Normal Animals

Normal, wild-type animals may be used to perform toxicity studies of antisense oligonucleotides targeted to huntingtin. The antisense compounds are administered systemically (e.g. via intraperitoneal injection) at doses of 25, 50, 75, or 100 mg/kg. Animals are monitored for any clinical changes, including changes in body weight. Serum is collected periodically, for example every week or every two weeks, during the dosing period and subjected to analysis using a clinical analyzer to detect any changes in serum chemistry profiles. At the end of the study, the animals are sacrificed. Blood is collected and analyzed for white blood cell count, platelet count, and serum chemistry. The weights of major organs are determined, and histological analyses are performed on spleen, liver, kidney and pancreas.

Huntington's Disease Models

Antisense compounds targeted to huntingtin may be tested in experimental non-human models of Huntington's disease. Several non-human models have been developed and characterized.

The R6/2 transgenic mouse model has integrated into its genome 1 kilobase of the human huntingtin gene, including the 5'-UTR exon 1 and the first 262 basepairs of intron 1 (Mangiarin L. et al., *Cell*, 1996, 87, 493-506). This transgene has 144 CAG repeats. The transgene encodes for approximately 3% of the N-terminal region of the huntingtin protein, expression of which is driven by the human huntingtin promoter. Expression levels of this truncated version of human huntingtin protein are approximately 75% of the endogenous mouse huntingtin protein levels. The R6/2 transgenic mice exhibit symptomos of human Huntington's disease and brain dysfunction.

The YAC128 transgenic mice harbor a yeast artificial chromosome (YAC) carrying the entire huntingtin gene, including the promoter region and 128 CAG repeats (Hodgson J. G. et al., *Human Mol. Genet*, 1998, 5, 1875). This YAC expresses all but exon 1 of the human gene. These transgenic mice do not express endogenouse mouse huntingtin.

The endogenous mouse huntingtin gene of the Q111 mice has 111 CAG repeats inserted into exon 1 of the gene (Wheeler V. C. et al., *Human Mol. Genet*, 8, 115-122).

In the Q150 transgenic mice, the CAG repeat in exon 1 of the wild-type mouse huntingtin gene is replaced with 150 CAG repeats (Li C. H. et al., *Human Mol. Genet*, 2001, 10, 137).

Antisense compounds targeted to huntingtin are administered to the non-human experimental model, for example to transgenic mice that are used as models of Huntington's disease.

Antisense compounds may be administered directly into the central nervous system of the experimental animal, for example through intracerebroventricular (ICV), intrathecal (IT) or intraparenchymal administration. Dosages of antisense compounds administered may be 25, 50, 75, or 100 ug/day, and administration may be accomplished through continuous infusion using a surgically implanted osmotic pump (e.g. an Alzet mini-pump). 0.25, 0.5, or 1 uL/hour. Each dosage is administered to groups of 4 to 6 animals. Control groups of animals may receive saline infusion, or infusion of an antisense compound having a sequence not targeted to any known gene.

Animals are treated for several weeks, for example 1, 2, 4, or 8 weeks. Animals are monitored for any clinical changes, including changes in body weight. At the end of the treatment period, animals are sacrificed. The brains are dissected into three regions: forebrain, basal ganglion, and cerebellum. Brain regions undergo histological assessment, including hemotoxylin/eosin staining, GFAP staining (to assess glial cell activation) and FluoroJ staining (to assess neurodegenerative changes). Huntingtin mRNA levels are measured by real-time PCR, and huntingtin protein levels are measured by immunoblotting (western blotting).

The duration of action of antisense compounds targeting huntingtin may also be evaluated. For such analyses, animals are dosed for 2, 4, 6, or 8 weeks with antisense compounds targeting huntingtin. At the end of the dosing period, the osmotic pumps are removed and animals are sacrificed 0, 1, 2, 4, 6, or 8 weeks following dosing termination. The brains are dissected into three regions: forebrain, basal ganglion, and cerebellum. Brain regions undergo histological assessment, including hemotoxylin/eosin staining, GFAP staining (to assess glial cell activation) and FluoroJ staining (to assess neurodegenerative changes). Huntingtin mRNA levels are measured by real-time PCR, and huntingtin protein levels are measured by immunoblotting (western blotting).

Kits, Research Reagents, and Diagnostics

The oligomeric compounds of the present invention can be utilized for diagnostics, research reagents and kits. Furthermore, antisense compounds, which are able to inhibit gene expression with specificity, are often used by those of ordinary skill to elucidate the function of particular genes or to distinguish between functions of various members of a biological pathway.

For use in kits and diagnostics, the oligomeric compounds of the present invention, either alone or in combination with other compounds or therapeutics, can be used as tools in differential and/or combinatorial analyses to elucidate expression patterns of a portion or the entire complement of genes expressed within cells and tissues.

As one nonlimiting example, expression patterns within cells or tissues treated with one or more compounds or compositions of the present invention are compared to control cells or tissues not treated with compounds and the patterns produced are analyzed for differential levels of gene expression as they pertain, for example, to disease association, signaling pathway, cellular localization, expression level, size, structure or function of the genes examined. These analyses can be performed on stimulated or unstimulated cells and in the presence or absence of other compounds which affect expression patterns. By way of example, gene expression patterns may be identified by microarray analysis.

Nonlimiting Disclosure and Incorporation by Reference

While certain compounds, compositions and methods of the present invention have been described with specificity in accordance with certain embodiments, the following examples serve only to illustrate the compounds of the invention and are not intended to limit the same. Each of the references, GENBANK® accession numbers, and the like recited in the present application is incorporated herein by reference in its entirety.

Example 1

Antisense Inhibition of Huntingtin in Culture Cells

The effect of oligomeric compounds on target nucleic acid expression was tested in cultured cells, for example A549 cells or HD patient fibroblasts for compounds targeted to human huntingtin, and in b.END cells for compounds targeted to mouse huntingtin.

When cells reached 65-75% confluency, the transfection reagent LIPOFECTIN® was used to introduce oligonucleotide into cells. Other methods of transfection are well known to those skilled in the art. The method of screening is not a limitation of the instant invention.

Oligonucleotide was mixed with LIPOFECTIN® Invitrogen Life Technologies, Carlsbad, Calif.) in OPTI-MEM®-1 reduced serum medium (Invitrogen Life Technologies, Carlsbad, Calif.) to achieve the desired concentration of oligonucleotide and a LIPOFECTIN® concentration of 2.5 or 3 μg/mL per 100 nM oligonucleotide. This transfection mixture was incubated at room temperature for approximately 0.5 hours. For cells grown in 96-well plates, wells were washed once with 100 μL OPTI-MEM®-1 and then treated with 130 μL of the transfection mixture. Cells are treated and data were obtained in duplicate or triplicate. After approximately 4-7 hours of treatment at 37° C., the medium containing the transfection mixture was replaced with fresh culture medium. Cells were harvested 16-24 hours after oligonucleotide treatment.

For culture chambers other than 96-well plates, the cells may be treated similarly, using appropriate volumes of medium and oligonucleotide.

Example 2

Real-Time Quantitative PCR Analysis of Huntingtin mRNA Levels

Quantitation of huntingtin mRNA levels was accomplished by real-time quantitative PCR using the ABI PRISM® 7600, 7700, or 7900 Sequence Detection System (PE-Applied Biosystems, Foster City, Calif.) according to manufacturer's instructions.

After isolation from cells or tissues, RNA was subjected to sequential reverse transcriptase (RT) reaction and real-time PCR, both of which are performed in the same well. RT and PCR reagents were obtained from Invitrogen Life Technologies (Carlsbad, Calif.). RT, real-time PCR was carried out in the same by adding 20 µL PCR cocktail (2.5×PCR buffer minus $MgCl_2$, 6.6 mM $MgCl_2$, 375 µM each of dATP, dCTP, dCTP and dGTP, 375 nM each of forward primer and reverse primer, 125 nM of probe, 4 Units RNAse inhibitor, 1.25 Units PLATINUM® Taq, 5 Units MuLV reverse transcriptase, and 2.5×ROX dye) to 96-well plates containing 30 µL total RNA solution (20-200 ng). The RT reaction was carried out by incubation for 30 minutes at 48° C. Following a 10 minute incubation at 95° C. to activate the PLATINUM® Taq, 40 cycles of a two-step PCR protocol were carried out: 95° C. for 15 seconds (denaturation) followed by 60° C. for 1.5 minutes (annealing/extension).

Gene target quantities obtained by RT, real-time PCR were normalized using either the expression level of GAPDH, a gene whose expression is constant, or by quantifying total RNA using RIBOGREEN® (Molecular Probes, Inc. Eugene, Oreg.). GAPDH expression was quantified by RT, real-time PCR, by being run simultaneously with the target, multiplexing, or separately. Total RNA was quantified using RIBOGREEN® RNA quantification reagent (Molecular Probes, Inc. Eugene, Oreg.) according to the manufacturer's instructions.

Probes and primers for use in real-time PCR were designed to hybridize to target-specific sequences. The primers and probes and the target nucleic acid sequences to which they hybridize are presented in Table 3. The target-specific PCR probes have FAM covalently linked to the 5' end and TAMRA or MGB covalently linked to the 3' end, where FAM is the fluorescent dye and TAMRA or MGB is the quencher dye.

TABLE 3

Gene target-specific primers and probes for use in real-time PCR

| Target Species | SEQ ID NO | Sequence Description | Sequence (5' to 3') | SEQ ID NO |
|---|---|---|---|---|
| Human | 4 | Forward Primer | CTCCGTCCGGTAGACATGCT | 38 |
| Human | 4 | Reverse Primer | GGAAATCAGAACCCTCAAAATGG | 39 |
| Human | 4 | Probe | TGAGCACTGTTCAACTGTGGATATCGGGA | 40 |
| Mouse | 10 | Forward Primer | CAGAGCTGGTCAACCGTATCC | 41 |
| Mouse | 10 | Reverse Primer | GGCTTAAACAGGGAGCCAAAA | 42 |
| Mouse | 10 | Probe | ACTTCATGATGAGCTCGGAGTTCAAC | 43 |

Example 3

Antisense Inhibition of the Huntingtin Gene

Human Huntingtin

Antisense oligonucleotides were designed to target different regions of the human huntingtin gene, using published sequences cited in Table 2. The sequences and corresponding SEQ ID NOs are shown in Table 4. All compounds in Table 4 are chimeric oligonucleotides ("gapmers") 20 nucleotides in length, composed of a central "gap" region consisting of 10 2'-deoxynucleotides, which is flanked on both sides (5' and 3') by five-nucleotide "wings". The wings are composed of 2'-O-(2-methoxyethyl) nucleotides, also known as 2'-MOE nucleotides. The internucleoside (backbone) linkages are phosphorothioate throughout the oligonucleotide. All cytidine residues are 5-methylcytidines.

The antisense oligonucleotides were analyzed for their effect on huntingtin mRNA levels in A549 cells by quantitative real-time PCR as described in other examples herein. The data presented in Table 4 represent percent inhibition of huntingtin mRNA levels relative to untreated cells. Data are averages from experiments in which cultured cells were treated with the disclosed antisense oligonucleotides, If the huntingtin mRNA level in antisense oligonucleotide-treated cells was equal to or higher than in control cells, percent inhibition is expressed as zero inhibition. If present, "N.D." indicates "not determined." The target regions to which these antisense oligonucleotides are inhibitory are herein referred to as "validated target segments."

TABLE 4

Inhibition of huntingtin mRNA levels by chimeric oligonucleotides having 2'-MOE wings and deoxy gap

| ISIS # | Target SEQ ID NO | 5' Target Site | Sequence (5' to 3') | % Inhib | SEQ ID NO |
|---|---|---|---|---|---|
| 388224 | 4 | 33 | CAGGTAAAAGCAGAACCTGA | 0 | 46 |
| 387865 | 4 | 155 | GCCTTCATCAGCTTTTCCAG | 65 | 47 |
| 388829 | 4 | 193 | GCTGCTGCTGCTGCTGGAAG | 46 | 48 |
| 388830 | 4 | 194 | TGCTGCTGCTGCTGCTGCTG | 46 | 49 |
| 388833 | 4 | 195 | CTGCTGCTGTTGCTGCTGCT | 62 | 50 |
| 388831 | 4 | 195 | CTGCTGCTGCTGCTGCTGCT | 56 | 51 |
| 388832 | 4 | 196 | GCTGCTGCTGCTGCTGCTGC | 36 | 52 |
| 388834 | 4 | 198 | TGGCGGCTGCTGCTGCTGCT | 62 | 53 |
| 388835 | 4 | 259 | GCGGCGGCGGCGGTGGCGGC | 52 | 54 |
| 387866 | 4 | 432 | ATGATTCACACGGTCTTTCT | 76 | 55 |
| 387867 | 4 | 489 | AAATTCTGGAGAATTTCTGA | 31 | 56 |
| 387868 | 4 | 497 | AGTTTCTGAAATTCTGGAGA | 58 | 57 |
| 387869 | 4 | 608 | GAATCCATCAAAGCTTTGAT | 53 | 58 |
| 387870 | 4 | 621 | CCTTGGAAGATTAGAATCCA | 45 | 59 |
| 387871 | 4 | 709 | GAGCCAGCTCAGCAAACCTC | 65 | 60 |
| 387872 | 4 | 718 | GAACCAGGTGAGCCAGCTCA | 37 | 61 |
| 387873 | 4 | 749 | TTCACCAGGTAAGGCCTGCA | 33 | 62 |
| 387874 | 4 | 821 | ACAGCTGCAGCCAAGGTCTC | 60 | 63 |
| 387875 | 4 | 845 | CCAAAAGAAGCCATAATTTT | 63 | 64 |
| 387876 | 4 | 876 | AACCTTAATTTCATTGTCAT | 75 | 65 |
| 388225 | 4 | 1000 | GTAGCCAACTATAGAAATAT | 53 | 66 |
| 388226 | 4 | 1005 | ATTTAGTAGCCAACTATAGA | 26 | 67 |
| 387877 | 4 | 1170 | AGAGACTTCCATTTCTTTCC | 81 | 68 |
| 387878 | 4 | 1176 | AGAAGGAGAGACTTCCATTT | 41 | 69 |
| 387879 | 4 | 1184 | TGCTCTGCAGAAGGAGAGAC | 46 | 70 |
| 387880 | 4 | 1201 | CATAAACCTGGACAAGCTGC | 79 | 71 |
| 387881 | 4 | 1208 | GTCAGTTCATAAACCTGGAC | 72 | 72 |
| 387882 | 4 | 1241 | ACATTGTGGTCTTGGTGCTG | 51 | 73 |
| 387883 | 4 | 1460 | AAGAGCACTTTGCCTTTTTG | 66 | 74 |
| 388227 | 4 | 1596 | TGCTGACCCTGGAGTGGAAA | 78 | 75 |
| 388228 | 4 | 1666 | TGGCCAGATCCACTGAGTCC | 30 | 76 |
| 387884 | 4 | 1775 | TCATTCAGGTCCATGGCAGG | 61 | 77 |
| 387885 | 4 | 1782 | GGTCCCATCATTCAGGTCCA | 68 | 78 |
| 387886 | 4 | 1876 | CTAACACAATTTCAGAACTG | 73 | 79 |
| 388229 | 4 | 1990 | TGGAAGAGTTCCTGAAGGCC | 29 | 80 |
| 388230 | 4 | 2022 | GTTTTTCAATAAATGTGCCT | 58 | 81 |
| 388231 | 4 | 2034 | GCAGTGACTCATGTTTTTCA | 60 | 82 |
| 388232 | 4 | 2039 | TGCCTGCAGTGACTCATGTT | 37 | 83 |
| 388233 | 4 | 2346 | GTCAAGAGGAACTTTATAGA | 55 | 84 |
| 387887 | 4 | 2400 | ATCGATGTAGTTCAAGATGT | 29 | 85 |
| 387888 | 4 | 2447 | GTCCCACAGAGAATGGCAGT | 73 | 86 |
| 388234 | 4 | 2677 | TGATCAGCTGCAGTCCTAAC | 1 | 87 |
| 387889 | 4 | 2820 | TGTATAATGATGAGCCCCTC | 76 | 88 |
| 387890 | 4 | 2971 | GATCAGCTTGTCCTTGGTCA | 81 | 89 |
| 388235 | 4 | 3183 | TCTGGTGGTTGATGTGATTA | 63 | 90 |
| 388236 | 4 | 3190 | TGAGTGCTCTGGTGGTTGAT | 26 | 91 |
| 387891 | 4 | 3203 | CAGCATCCAAATGTGAGTGC | 82 | 92 |
| 387892 | 4 | 3209 | GCTTCACAGCATCCAAATGT | 89 | 93 |
| 388237 | 4 | 3234 | GAAGGCAGTGGAAAGAAGAC | 62 | 94 |
| 387893 | 4 | 3641 | AGAGAAGGCAAGGCTGCCTT | 60 | 95 |
| 387894 | 4 | 3649 | GGTTTGTTAGAGAAGGCAAG | 63 | 96 |
| 387895 | 4 | 3851 | ACATCATGCAGTTTGAGGTA | 68 | 97 |
| 387896 | 4 | 3860 | GCTTTCAGGACATCATGCAG | 51 | 98 |
| 387897 | 4 | 4028 | AAGCAGGATTTCAGGTATCC | 78 | 99 |
| 387898 | 4 | 4036 | CTCGACTAAAGCAGGATTTC | 90 | 100 |
| 387899 | 4 | 4055 | ACAGTTGCCATCATTGGTTC | 67 | 101 |
| 388238 | 4 | 4069 | ATTGTTGAACACAAACAGTT | 50 | 102 |
| 387900 | 4 | 4127 | TTGGAAGATAAGCCATCAAA | 82 | 103 |
| 387901 | 4 | 4265 | TGCACCATGTTCCTCAGGCT | 79 | 104 |
| 387902 | 4 | 4269 | CGCCTGCACCATGTTCCTCA | 90 | 105 |
| 387903 | 4 | 4380 | AATAGCATTCTTATCTGCAC | 84 | 106 |
| 387904 | 4 | 4392 | AATGTGATTATGAATAGCAT | 64 | 107 |
| 388239 | 4 | 4458 | TAACTGCACACATGTTGTAG | 54 | 108 |
| 387905 | 4 | 4538 | AACACCTGATCTGAATCCAG | 78 | 109 |
| 388240 | 4 | 4558 | GTTTCAATACAAAGCCAATA | 78 | 110 |
| 387906 | 4 | 4586 | AACTGGCCCACTTCAATGTA | 78 | 111 |
| 387907 | 4 | 4596 | TGATTCCCTGAACTGGCCCA | 77 | 112 |
| 387908 | 4 | 4682 | TTAGGAATTCCAATGATCTG | 76 | 113 |
| 387909 | 4 | 4688 | ATGATTTAGGAATTCCAAT | 77 | 114 |
| 387910 | 4 | 4715 | CTGGCCATGATGCCATCACA | 86 | 115 |
| 387911 | 4 | 4724 | TTCCTTCCACTGGCCATGAT | 77 | 116 |
| 387912 | 4 | 4805 | GCATCAGCTTTATTTGTTCC | 70 | 117 |
| 388241 | 4 | 4856 | CTCAGTAACATTGACACCAC | 71 | 118 |

TABLE 4-continued

Inhibition of huntingtin mRNA levels by chimeric oligonucleotides having 2'-MOE wings and deoxy gap

| ISIS # | Target SEQ ID NO | 5' Target Site | Sequence (5' to 3') | % Inhib | SEQ ID NO |
|---|---|---|---|---|---|
| 388242 | 4 | 4868 | TACTGGATGAGTCTCAGTAA | 49 | 119 |
| 387913 | 4 | 4875 | CTGATGGTACTGGATGAGTC | 59 | 120 |
| 387914 | 4 | 4913 | TGGCACTGCTGCAGGACAAG | 71 | 121 |
| 387915 | 4 | 5219 | TCCTGAATACGAGAAAGAAC | 86 | 122 |
| 388243 | 4 | 5781 | TTTGGCTGCCAAGTCAGAAT | 52 | 123 |
| 388244 | 4 | 5787 | TCCAAGTTTGGCTGCCAAGT | 48 | 124 |
| 387916 | 4 | 5801 | TCTCTATTGCACATTCCAAG | 91 | 125 |
| 387917 | 4 | 5850 | CTGACAGACATAATCACAGA | 61 | 126 |
| 387918 | 4 | 5911 | TGATCAGATCTTGAATGTGA | 41 | 127 |
| 387919 | 4 | 6005 | CGAGACTGAATTGCCTGGAT | 59 | 128 |
| 387920 | 4 | 6296 | GAATAGAGCCTTTGGTGTCT | 56 | 129 |
| 388245 | 4 | 6333 | GTCTTGCATGGTGGAGAGAC | 39 | 130 |
| 387921 | 4 | 6466 | AATCTGACCTGGTCCAACAC | 65 | 131 |
| 387922 | 4 | 6476 | AGCAGTGCAGAATCTGACCT | 53 | 132 |
| 387923 | 4 | 6488 | TCTGCACCTTCCAGCAGTGC | 62 | 133 |
| 388246 | 4 | 6600 | ACCAGAAATTTCACTCATCC | 50 | 134 |
| 388247 | 4 | 6606 | CTGGCCACCAGAAATTTCAC | 21 | 135 |
| 388248 | 4 | 6763 | CAGCATCCCCAAACAGATCA | 65 | 136 |
| 388249 | 4 | 6769 | ACAGTGCAGCATCCCCAAAC | 72 | 137 |
| 388250 | 4 | 6777 | GGACTGATACAGTGCAGCAT | 65 | 138 |
| 387924 | 4 | 6860 | TTCTCAGGAGGAAGGTGCAA | 61 | 139 |
| 387925 | 4 | 6930 | CTGCTCATGGATCAAATGCC | 78 | 140 |
| 388251 | 4 | 7177 | GTGTGTTTGGATCTACTTCC | 67 | 141 |
| 388252 | 4 | 7199 | GCAGTGATATACTTAGGATT | 46 | 142 |
| 388253 | 4 | 7208 | TCACAGGCTGCAGTGATATA | 29 | 143 |
| 388254 | 4 | 7312 | TGATGTTCCTGAGCAATGGC | 51 | 144 |
| 388255 | 4 | 7383 | TCCAAGCTTCCACACCAGTG | 67 | 145 |
| 387926 | 4 | 7489 | TGTTGATGCGGTAGATGAAC | 29 | 146 |
| 387927 | 4 | 7556 | GTCACCAGGACACCAAGGAG | 70 | 147 |
| 387928 | 4 | 7709 | TCCAAGCAGCTTACAGCTGG | 69 | 148 |
| 388256 | 4 | 7816 | TTGAAACCATTGCTTGAATC | 64 | 149 |
| 388257 | 4 | 7855 | ATGCCTGATATAAATGATGG | 52 | 150 |
| 387942 | 4 | 7932 | GTTGATCTGCAGCAGCAGCT | 39 | 151 |
| 387929 | 4 | 7988 | GAGTGTATGGACACCTGGCC | 49 | 152 |
| 387930 | 4 | 8005 | TGTTCCCCAGCCACACGGAG | 85 | 153 |
| 387931 | 4 | 8363 | GTGGCAGGCACCAGGTACTG | 65 | 154 |
| 388258 | 4 | 8655 | ATAGTTCTCAATGAGGTAAA | 72 | 155 |
| 387932 | 4 | 8757 | ACAGTGGTAAATGATGGAGG | 41 | 156 |
| 387933 | 4 | 8903 | ATGCAGGTGAGCATCAGGCC | 29 | 157 |
| 387934 | 4 | 8910 | TGTGTACATGCAGGTGAGCA | 37 | 158 |
| 388259 | 4 | 9036 | AGGAAAGCCTTTCCTGATCC | 31 | 159 |
| 387935 | 4 | 9149 | TATGGCTGCTGGTTGGACAG | 57 | 160 |
| 387936 | 4 | 9240 | CAGCATGACCCAGTCCCGGA | 63 | 161 |
| 387937 | 4 | 9243 | GGACAGCATGACCCAGTCCC | 68 | 162 |
| 387938 | 4 | 9368 | CCCATCCTGCTGATGACATG | 69 | 163 |
| 387939 | 4 | 9407 | ACCAGGCAGAAAAGGTTCAC | 63 | 164 |
| 387940 | 4 | 9555 | TCAGCAGGTGGTGACCTTGT | 64 | 165 |
| 388260 | 4 | 9714 | TCTGCCACATGGCAGAGACA | 25 | 166 |
| 388261 | 4 | 9724 | AAAGAGCACTTCTGCCACAT | 56 | 167 |
| 388262 | 4 | 9735 | GCCACTGCCACAAAGAGCAC | 60 | 168 |
| 388263 | 4 | 9763 | CACCAGGACTGAGACACTC | 65 | 169 |
| 388264 | 4 | 9785 | TGGAAGGCCTCAGGCTCAGC | 65 | 170 |
| 388265 | 4 | 9831 | GGACCTGGTCACCCACATGG | 22 | 171 |
| 388266 | 4 | 9863 | GGCAACAACCAGCAGGTGAC | 54 | 172 |
| 388267 | 4 | 9871 | TGCAACCTGGCAACAACCAG | 32 | 173 |
| 388268 | 4 | 9889 | CCCAGATGCAAGAGCAGCTG | 65 | 174 |
| 388269 | 4 | 9921 | AACAGCCAGCCTGCAGGAGG | 25 | 175 |
| 388270 | 4 | 9946 | TCTACTGCAGGACAGCAGAG | 20 | 176 |
| 388271 | 4 | 9973 | TGTTCCCAAAGCCTGCTCAC | 43 | 177 |
| 388272 | 4 | 9982 | CCAGGCCAGTGTTCCCAAAG | 41 | 178 |
| 388273 | 4 | 9988 | GGAGACCCAGGCCAGTGTTC | 44 | 179 |
| 388274 | 4 | 10047 | AGCACAGGCCATGGCATCTG | 43 | 180 |
| 388275 | 4 | 10054 | CTGGCCCAGCACAGGCCATG | 33 | 181 |
| 387941 | 4 | 10133 | ACTGATATAATTAAATTTTA | 0 | 182 |
| 388276 | 4 | 10274 | GGCTATGCCAGTGGCTACAG | 29 | 183 |
| 388277 | 4 | 10329 | TGTGAATGCATAAACAGGAA | 61 | 184 |
| 388278 | 4 | 10579 | CTAGCAAGGAACAGGAGTGG | 15 | 185 |
| 388279 | 4 | 10639 | CCATGGAGCAGCAGGTCCCA | 28 | 186 |
| 388280 | 4 | 10647 | GCATGCATCCATGGAGCAGC | 31 | 187 |
| 388281 | 4 | 10726 | ACTAACAGTGCCAAGACACC | 45 | 188 |
| 388282 | 4 | 10923 | CCATTTTAATGACTTGGCTC | 60 | 189 |
| 388283 | 4 | 11023 | AGGAAGCAGAGCCCCTGCCT | 48 | 190 |
| 388284 | 4 | 11150 | GGCAGCACCTGCACAGAGTT | 57 | 191 |

TABLE 4-continued

Inhibition of huntingtin mRNA levels by chimeric oligonucleotides having 2'-MOE wings and deoxy gap

| ISIS # | Target SEQ ID NO | 5' Target Site | Sequence (5' to 3') | % Inhib | SEQ ID NO |
|---|---|---|---|---|---|
| 388285 | 4 | 11225 | GCATACAAGTCCACATCTCA | 54 | 192 |
| 388286 | 4 | 11293 | CATACAGGCCTGGCAGAGGC | 49 | 193 |
| 388287 | 4 | 11449 | AAGAATGGTGATTTTCTTAC | 46 | 194 |
| 388288 | 4 | 11637 | TCTAGCCAGGAACAACATCT | 47 | 195 |
| 388289 | 4 | 11646 | ATGTAAACATCTAGCCAGGA | 24 | 196 |
| 388290 | 4 | 11854 | AATGAGCTCATATTCATCTC | 20 | 197 |
| 388291 | 4 | 12076 | GAATGAGCCCTGCCCTGACC | 38 | 198 |
| 388292 | 4 | 12081 | GCAATGAATGAGCCCTGCCC | 57 | 199 |
| 388293 | 4 | 12122 | AGCTGATATGGAGACCATCT | 35 | 200 |
| 388294 | 4 | 12177 | GGTGCTTGCCACAGATTTTT | 65 | 201 |
| 388295 | 4 | 12324 | TGCATTGCCAAACAATTCTA | 57 | 202 |
| 388296 | 4 | 12409 | TTGGCAGCTGGAAACATCAC | 52 | 203 |
| 388297 | 4 | 12873 | TCCAAGTCTACCCTGGCCAG | 40 | 204 |
| 388298 | 4 | 13044 | GTTGCCTTCAGTTGTCATGC | 34 | 205 |
| 388299 | 4 | 13050 | TTCCAGGTTGCCTTCAGTTG | 59 | 206 |
| 388300 | 4 | 13167 | CAGTTACCACCCAGATTGCA | 46 | 207 |
| 388301 | 4 | 13251 | GAGACCTGGACAAGGAGGCC | 30 | 208 |
| 388842 | 5 | 3535 | TGTAATTACAGAATTTGTAT | 60 | 209 |
| 388852 | 5 | 16048 | ACATTCCATGAATTCCATTT | 43 | 210 |
| 388846 | 5 | 17007 | GTTAATTTAGAGAAAATTCA | 1 | 211 |
| 388845 | 5 | 24805 | CAGAAGCATCCAAACCAGTA | 40 | 212 |
| 388844 | 5 | 31595 | CAAGAGGGTTGCATAGAAAC | 17 | 213 |
| 388848 | 5 | 41489 | CAAAGTATAAACAGTTTGAG | 32 | 214 |
| 388839 | 5 | 41869 | CCCAGTGCAGTTCACATTCA | 54 | 215 |
| 388859 | 5 | 46461 | TATTATAAAATACATGTTTC | 26 | 216 |
| 388856 | 5 | 58668 | ATTAGAGATTCATCATATTG | 46 | 217 |
| 388857 | 5 | 59960 | GGTATGGAAAGGTTCAACAT | 58 | 218 |
| 388858 | 5 | 64678 | TGGAAGGTGAGGGACAAAAA | 57 | 219 |
| 388862 | 5 | 71659 | AGCAGAAACAAGTATTCCAT | 56 | 220 |
| 388853 | 5 | 86173 | CAAATTCACATAGGGTTGGT | 60 | 221 |
| 388860 | 5 | 97067 | ACATGAGCAATGAAGGACAG | 48 | 222 |
| 388840 | 5 | 98221 | GCAATGTGTGATTTACCACA | 67 | 223 |
| 388850 | 5 | 118154 | ACCACATCATAATTTGTCAT | 41 | 224 |
| 388855 | 5 | 120499 | ATTATTTAAGAAGTACCCAC | 36 | 225 |
| 388861 | 5 | 121068 | TGCCCCAAAAAGTGGAACCA | 55 | 226 |
| 388847 | 5 | 126660 | ACATTTCCAAGAGGTTTTGA | 48 | 227 |
| 388854 | 5 | 128596 | TCAGCCCCAATTTGTAGCAG | 59 | 228 |
| 388841 | 5 | 140692 | GACATAAAGTTTAGAGGTAT | 50 | 229 |
| 388843 | 5 | 142578 | GAAGGACCCACAGAGGTTTG | 53 | 230 |
| 388851 | 5 | 146457 | TGAAAAGGAAGTGACATCAT | 17 | 231 |
| 388849 | 5 | 165574 | CAGTGTCAGGAGAAGCCCAG | 46 | 232 |
| 388785 | 45 | 713 | AGGTTCTGCCTCACACAGCA | 57 | 311 |
| 388786 | 45 | 718 | CCCGCAGGTTCTGCCTCACA | 33 | 312 |
| 388787 | 45 | 740 | AGGGAACCAGCCCGCCCCTG | 56 | 313 |
| 388788 | 45 | 745 | TGGCCAGGGAACCAGCCCGC | 47 | 314 |
| 388789 | 45 | 750 | ATGGCTGGCCAGGGAACCAG | 25 | 315 |
| 388790 | 45 | 755 | TGCCAATGGCTGGCCAGGGA | 7 | 316 |
| 388791 | 45 | 777 | GACAGCCCTAGCCTGCGGAC | 19 | 317 |
| 388792 | 45 | 781 | GATTGACAGCCCTAGCCTGC | 0 | 318 |
| 388793 | 45 | 785 | GCATGATTGACAGCCCTAGC | 9 | 319 |
| 388794 | 45 | 885 | ATCTTGGACCCGTCCCGGCA | 63 | 320 |
| 388795 | 45 | 890 | CGTCCATCTTGGACCCGTCC | 53 | 321 |
| 388796 | 45 | 896 | AGCGGCCGTCCATCTTGGAC | 45 | 322 |
| 388797 | 45 | 902 | AACCTGAGCGGCCGTCCATC | 54 | 323 |
| 388798 | 45 | 906 | GCAGAACCTGAGCGGCCGTC | 62 | 324 |
| 388799 | 45 | 910 | AAAAGCAGAACCTGAGCGGC | 56 | 325 |
| 388800 | 45 | 913 | GGTAAAAGCAGAACCTGAGC | 36 | 326 |
| 388801 | 45 | 920 | GGCCGCAGGTAAAAGCAGAA | 65 | 327 |
| 388802 | 45 | 926 | GCTCTGGGCCGCAGGTAAAA | 64 | 328 |
| 388803 | 45 | 985 | AGTCCCCGGAGGCCTCGGGC | 56 | 329 |
| 388804 | 45 | 993 | GGCACGGCAGTCCCCGGAGG | 57 | 330 |
| 388805 | 45 | 1019 | AGGGTCGCCATGGCGGTCTC | 35 | 331 |
| 388806 | 45 | 1025 | TTTTCCAGGGTCGCCATGGC | 33 | 332 |
| 388807 | 45 | 1030 | TCAGCTTTTCCAGGGTCGCC | 63 | 333 |
| 388808 | 45 | 1034 | TTCATCAGCTTTTCCAGGGT | 54 | 334 |
| 388809 | 45 | 1040 | AAGGCCTTCATCAGCTTTTC | 48 | 335 |
| 388810 | 45 | 1045 | ACTCGAAGGCCTTCATCAGC | 57 | 336 |
| 388811 | 45 | 1050 | GAGGGACTCGAAGGCCTTCA | 51 | 337 |
| 388812 | 45 | 1056 | GGACTTGAGGGACTCGAAGG | 62 | 338 |
| 388836 | 45 | 1494 | CTGAGGAAGCTGAGGAGGCG | 45 | 339 |
| 388837 | 45 | 1511 | TGTGCCTGCGGCGGCGGCTG | 61 | 340 |
| 388838 | 45 | 1523 | GGCAGCAGCGGCTGTGCCTG | 53 | 341 |
| 388813 | 45 | 1607 | CAAACTCACGGTCGGTGCAG | 58 | 342 |

TABLE 4-continued

Inhibition of huntingtin mRNA levels by chimeric oligonucleotides having 2'-MOE wings and deoxy gap

| ISIS # | Target SEQ ID NO | 5' Target Site | Sequence (5' to 3') | % Inhib | SEQ ID NO |
|---|---|---|---|---|---|
| 388814 | 45 | 1614 | GCGGGCCCAAACTCACGGTC | 51 | 343 |
| 388815 | 45 | 1623 | GGAGCTGCAGCGGGCCCAAA | 39 | 344 |
| 388816 | 45 | 1650 | GCCGTAGCCTGGGACCCGCC | 77 | 345 |
| 388817 | 45 | 1670 | GCAGGGTTACCGCCATCCCC | 70 | 346 |
| 388818 | 45 | 1675 | AGGCTGCAGGGTTACCGCCA | 66 | 347 |
| 388819 | 45 | 1680 | CCCGCAGGCTGCAGGGTTAC | 53 | 348 |
| 388820 | 45 | 1685 | GCCGGCCCGCAGGCTGCAGG | 49 | 349 |
| 388821 | 45 | 1773 | AAGGCCTCGCCCCAGGAGGG | 46 | 350 |
| 388822 | 45 | 1807 | AGACCCAAGTGAGGGAGCGG | 65 | 351 |
| 388823 | 45 | 1813 | AAGGGAAGACCCAAGTGAGG | 44 | 352 |
| 388824 | 45 | 1817 | GGACAAGGGAAGACCCAAGT | 68 | 353 |
| 388825 | 45 | 1825 | TCGCGAGAGGACAAGGGAAG | 24 | 354 |
| 388826 | 45 | 1830 | TCCCCTCGCGAGAGGACAAG | 59 | 355 |
| 388827 | 45 | 1850 | GGCCCCAACAAGGCTCTGCC | 58 | 356 |
| 388828 | 45 | 1855 | GGACAGGCCCCAACAAGGCT | 61 | 357 |

Mouse Huntingtin

Antisense oligonucleotides were designed to target different regions of the mouse huntingtin gene, using published sequences cited in Table 2. The sequences and corresponding SEQ ID NOs are shown in Table 5. All compounds in Table 5 are chimeric oligonucleotides ("gapmers") 20 nucleotides in length, composed of a central "gap" region consisting of 10 2'-deoxynucleotides, which is flanked on both sides (5' and 3') by five-nucleotide "wings". The wings are composed of 2'-O-(2-methoxyethyl) nucleotides, also known as 2'-MOE nucleotides. The internucleoside (backbone) linkages are phosphorothioate throughout the oligonucleotide. All cytidine residues are 5-methylcytidines.

The antisense oligonucleotides were analyzed for their effect on huntingtin mRNA levels in b.END cells by quantitative real-time PCR as described in other examples herein. The data presented in Table 5 represent percent inhibition of huntingtin mRNA levels relative to untreated cells. Data are averages from experiments in which cultured cells were treated with the disclosed antisense oligonucleotides.

If the huntingtin mRNA level in antisense oligonucleotide-treated cells was equal to or higher than in control cells, percent inhibition is expressed as zero inhibition. If present, "N.D." indicates "not determined." The target regions to which these antisense oligonucleotides are inhibitory are herein referred to as "validated target segments."

TABLE 5

Inhibition of mouse huntingtin mRNA levels by chimeric oligonucleotides having 2'-MOE wings and deoxy gap

| ISIS # | Target SEQ ID NO | Target Site | Sequence (5' to 3') | % Inhib | SEQ ID NO |
|---|---|---|---|---|---|
| 387869 | 8 | 517 | GAATCCATCAAAGCTTTGAT | 46 | 58 |
| 387884 | 8 | 1684 | TCATTCAGGTCCATGGCAGG | 54 | 77 |
| 387913 | 8 | 4787 | CTGATGGTACTGGATGAGTC | 32 | 120 |
| 387865 | 10 | 177 | GCCTTCATCAGCTTTTCCAG | 35 | 47 |
| 387866 | 10 | 394 | ATGATTCACACGGTCTTTCT | 38 | 55 |
| 387867 | 10 | 451 | AAATTCTGGAGAATTTCTGA | 22 | 56 |
| 387868 | 10 | 459 | AGTTTCTGAAATTCTGGAGA | 39 | 57 |
| 387870 | 10 | 583 | CCTTGGAAGATTAGAATCCA | 41 | 59 |
| 387871 | 10 | 671 | GAGCCAGCTCAGCAAACCTC | 34 | 60 |
| 387872 | 10 | 680 | GAACCAGGTGAGCCAGCTCA | 23 | 61 |
| 387874 | 10 | 783 | ACAGCTGCAGCCAAGGTCTC | 52 | 63 |
| 387875 | 10 | 807 | CCAAAAGAAGCCATAATTTT | 19 | 64 |
| 387876 | 10 | 838 | AACCTTAATTTCATTGTCAT | 42 | 65 |
| 387877 | 10 | 1132 | AGAGACTTCCATTTCTTTCC | 51 | 68 |
| 387878 | 10 | 1138 | AGAAGGAGAGACTTCCATTT | 24 | 69 |
| 387879 | 10 | 1146 | TGCTCTGCAGAAGGAGAGAC | 17 | 70 |
| 387880 | 10 | 1163 | CATAAACCTGGACAAGCTGC | 34 | 71 |
| 387882 | 10 | 1203 | ACATTGTGGTCTTGGTGCTG | 70 | 73 |
| 387883 | 10 | 1422 | AAGAGCACTTTGCCTTTTTG | 52 | 74 |
| 387885 | 10 | 1744 | GGTCCCATCATTCAGGTCCA | 44 | 78 |
| 387887 | 10 | 2365 | ATCGATGTAGTTCAAGATGT | 39 | 85 |
| 387888 | 10 | 2412 | GTCCCACAGAGAATGGCAGT | 31 | 86 |
| 387889 | 10 | 2785 | TGTATAATGATGAGCCCCTC | 48 | 88 |
| 387890 | 10 | 2936 | GATCAGCTTGTCCTTGGTCA | 55 | 89 |
| 387891 | 10 | 3168 | CAGCATCCAAATGTGAGTGC | 52 | 92 |
| 387892 | 10 | 3174 | GCTTCACAGCATCCAAATGT | 46 | 93 |
| 387893 | 10 | 3606 | AGAGAAGGCAAGGCTGCCTT | 46 | 95 |
| 387894 | 10 | 3614 | GGTTTGTTAGAGAAGGCAAG | 43 | 96 |
| 387895 | 10 | 3816 | ACATATGCAGTTTGAGGTA | 57 | 97 |
| 387896 | 10 | 3825 | GCTTTCAGGACATCATGCAG | 38 | 98 |
| 387897 | 10 | 3993 | AAGCAGGATTTCAGGTATCC | 60 | 99 |
| 387898 | 10 | 4001 | CTCGACTAAAGCAGGATTTC | 48 | 100 |
| 387899 | 10 | 4020 | ACAGTTGCCATCATTGGTTC | 35 | 101 |
| 387900 | 10 | 4092 | TTGGAAGATAAGCCATCAAA | 41 | 103 |
| 387901 | 10 | 4230 | TGCACCATGTTCCTCAGGCT | 64 | 104 |
| 387902 | 10 | 4234 | CGCCTGCACCATGTTCCTCA | 47 | 105 |

TABLE 5-continued

Inhibition of mouse huntingtin mRNA levels by chimeric oligonucleotides having 2'-MOE wings and deoxy gap

| ISIS # | Target SEQ ID NO | Target Site | Sequence (5' to 3') | % Inhib | SEQ ID NO |
|---|---|---|---|---|---|
| 387903 | 10 | 4345 | AATAGCATTCTTATCTGCAC | 46 | 106 |
| 387904 | 10 | 4357 | AATGTGATTATGAATAGCAT | 25 | 107 |
| 387905 | 10 | 4503 | AACACCTGATCTGAATCCAG | 29 | 109 |
| 387906 | 10 | 4551 | AACTGGCCCACTTCAATGTA | 64 | 111 |
| 387908 | 10 | 4647 | TTAGGAATTCCAATGATCTG | 74 | 113 |
| 387909 | 10 | 4653 | ATGATTTTAGGAATTCCAAT | 28 | 114 |
| 387910 | 10 | 4680 | CTGGCCATGATGCCATCACA | 27 | 115 |
| 387911 | 10 | 4689 | TTCCTTCCACTGGCCATGAT | 38 | 116 |
| 387912 | 10 | 4770 | GCATCAGCTTTATTTGTTCC | 45 | 117 |
| 387914 | 10 | 4878 | TGGCACTGCTGCAGGACAAG | 73 | 121 |
| 387915 | 10 | 5184 | TCCTGAATACGAGAAAGAAC | 8 | 122 |
| 387916 | 10 | 5763 | TCTCTATTGCACATTCCAAG | 59 | 125 |
| 387917 | 10 | 5812 | CTGACAGACATAATCACAGA | 55 | 126 |
| 387918 | 10 | 5873 | TGATCAGATCTTGAATGTGA | 69 | 127 |
| 387919 | 10 | 5967 | CGAGACTGAATTGCCTGGAT | 73 | 128 |
| 387920 | 10 | 6258 | GAATAGAGCCTTTGGTGTCT | 53 | 129 |
| 387921 | 10 | 6428 | AATCTGACCTGGTCCAACAC | 4 | 131 |
| 387922 | 10 | 6438 | AGCAGTGCAGAATCTGACCT | 16 | 132 |
| 387924 | 10 | 6822 | TTCTCAGGAGGAAGGTGCAA | 26 | 139 |
| 387925 | 10 | 6892 | CTGCTCATGGATCAAATGCC | 43 | 140 |
| 387926 | 10 | 7445 | TGTTGATGCGGTAGATGAAC | 8 | 146 |
| 387927 | 10 | 7512 | GTCACCAGGACACCAAGGAG | 47 | 147 |
| 387928 | 10 | 7665 | TCCAAGCAGCTTACAGCTGG | 31 | 148 |
| 387942 | 10 | 7888 | GTTGATCTGCAGCAGCAGCT | 54 | 151 |
| 387930 | 10 | 7961 | TGTTCCCCAGCCACACGGAG | 53 | 153 |
| 387931 | 10 | 8319 | GTGGCAGGCACCAGGTACTG | 62 | 154 |
| 387932 | 10 | 8713 | ACAGTGGTAAATGATGGAGG | 51 | 156 |
| 387933 | 10 | 8859 | ATGCAGGTGAGCATCAGGCC | 64 | 157 |
| 387934 | 10 | 8866 | TGTGTACATGCAGGTGAGCA | 45 | 158 |
| 387935 | 10 | 9105 | TATGGCTGCTGGTTGGACAG | 43 | 160 |
| 387936 | 10 | 9196 | CAGCATGACCCAGTCCGGA | 53 | 161 |
| 387937 | 10 | 9199 | GGACAGCATGACCCAGTCCC | 34 | 162 |
| 387938 | 10 | 9324 | CCCATCCTGCTGATGACATG | 41 | 163 |
| 387939 | 10 | 9363 | ACCAGGCAGAAAAGGTTCAC | 28 | 164 |
| 387940 | 10 | 9511 | TCAGCAGGTGGTGACCTTGT | 54 | 165 |
| 387941 | 10 | 10042 | ACTGATATAATTAAATTTTA | 3 | 182 |
| 387873 | 11 | 39021 | TTCACCAGGTAAGGCCTGCA | 28 | 62 |
| 387881 | 11 | 46216 | GTCAGTTCATAAACCTGGAC | 57 | 72 |
| 387886 | 11 | 52829 | CTAACACAATTTCAGAACTG | 25 | 79 |
| 388535 | 11 | 64098 | GATAAAACACCTTGTTAATG | 0 | 233 |
| 388536 | 11 | 74028 | GGAGCAGTACCTTATAGTTG | 0 | 234 |
| 388467 | 11 | 85701 | ATAGCTGCTGCACACAGACA | 37 | 235 |
| 387907 | 11 | 90911 | TGATTCCCTGAACTGGCCCA | 77 | 112 |
| 388534 | 11 | 90914 | GCATCAGTACCTGAACTGGC | 18 | 236 |
| 388532 | 11 | 116664 | GAGTGGTTGGCTAATGTTGA | 26 | 237 |
| 387923 | 11 | 119259 | TCTGCACCTTCCAGCAGTGC | 25 | 133 |
| 387929 | 11 | 138172 | GAGTGTATGGACACCTGGCC | 64 | 152 |
| 388533 | 11 | 142848 | CAGTTTTGTCCTGGATACAA | 0 | 238 |
| 388459 | 44 | 962 | GGAGCCAGTTGTAGAAGTAC | 4 | 239 |
| 388460 | 44 | 1284 | CCTGGTGTGGTCAGTGCTTG | 39 | 240 |
| 388461 | 44 | 1306 | CAGAGTGAGCTGCCCAAGCC | 18 | 241 |
| 388462 | 44 | 1317 | TCTTCTTGAACCGAGTGAG | 29 | 242 |
| 388463 | 44 | 1948 | GTTTCTGAAAACATCTGAGA | 13 | 243 |
| 388464 | 44 | 1998 | CTATGGCCCATTCTTTCCAA | 33 | 244 |
| 388465 | 44 | 2642 | TAAGCAGTTGTAATCCCAAG | 7 | 245 |
| 388466 | 44 | 3690 | GGACTCATTGGAGTAGAAGC | 34 | 246 |
| 388468 | 44 | 5944 | AAGACCACTAGCTGCAGAAT | 29 | 247 |
| 388469 | 44 | 6735 | TGGTATGATGTGGTATCACC | 53 | 248 |
| 388470 | 44 | 6855 | GTCATTACCACAAACTTCAC | 20 | 249 |
| 388471 | 44 | 7145 | GACTGAGGTTTTGTATATCT | 19 | 250 |
| 388472 | 44 | 7269 | ACAATGTTCTTCAGCACAGC | 24 | 251 |
| 388473 | 44 | 8515 | CAGCAGATAGTCACTAACAA | 20 | 252 |
| 388474 | 44 | 9228 | ACTGGAGTTCTTTGTGTGAA | 25 | 253 |
| 388475 | 44 | 9519 | GGCACTACTCAGCAGGTGGT | 49 | 254 |
| 388476 | 44 | 9532 | CTTTTGTCCCACAGGCACTA | 20 | 255 |
| 388477 | 44 | 9630 | CTTGACACAAGTGGAAGCCT | 15 | 256 |
| 388478 | 44 | 9676 | GCATAGCCCTCATTGCAAAG | 40 | 257 |
| 388479 | 44 | 9691 | TAGTGCATGTTCCCTGCATA | 45 | 258 |
| 388480 | 44 | 9701 | AACCCCAACATAGTGCATGT | 16 | 259 |
| 388481 | 44 | 9770 | AAGACAAACACCTGGTCAAC | 13 | 260 |
| 388482 | 44 | 9855 | AACCATCTGGCAAGAGCTAG | 23 | 261 |
| 388483 | 44 | 9924 | TGTGGCAGGTATGCCTACTG | 14 | 262 |

TABLE 5-continued

Inhibition of mouse huntingtin mRNA levels by chimeric oligonucleotides having 2'-MOE wings and deoxy gap

| ISIS # | Target SEQ ID NO | Target Site | Sequence (5' to 3') | % Inhib | SEQ ID NO |
|---|---|---|---|---|---|
| 388484 | 44 | 9932 | GACACTGGTGTGGCAGGTAT | 36 | 263 |
| 388485 | 44 | 10102 | CTTGCCAAGTCACACACTTT | 19 | 264 |
| 388486 | 44 | 10135 | ACTTCCATAAACTTTGTCAC | 7 | 265 |
| 388487 | 44 | 10181 | GACTGAGTAGCTACAGGAGA | 40 | 266 |
| 388488 | 44 | 10275 | TGCTGGCTTAATGGAATGCA | 34 | 267 |
| 388489 | 44 | 10315 | GGATTCTCACACAGGCAGTC | 39 | 268 |
| 388490 | 44 | 10330 | GTTAGGCCACAGGCAGGATT | 30 | 269 |
| 388491 | 44 | 10348 | CAGTTTTTCAGTTCCTCAGT | 51 | 270 |
| 388492 | 44 | 10370 | TTATAACTCTAACAGTGGAA | 24 | 271 |
| 388493 | 44 | 10460 | CTAGGAGAGTGCATCAACAC | 38 | 272 |
| 388494 | 44 | 10480 | TTTCTACCCAGGCTGAGAGA | 30 | 273 |
| 388495 | 44 | 10550 | CTACAGTGCAGGTCAGCCAC | 42 | 274 |
| 388496 | 44 | 10582 | CATCCACAATGGTCAGCTGG | 30 | 275 |
| 388497 | 44 | 10616 | CCCAACCATGCAGAAGATAC | 17 | 276 |
| 388498 | 44 | 10634 | GGTCAGCACTTCTCAGGTCC | 50 | 277 |
| 388499 | 44 | 10950 | TTAACATGACCTGGTTACTC | 27 | 278 |
| 388500 | 44 | 10988 | CCCAAACCAAGCCAGGAAAT | 19 | 279 |
| 388501 | 44 | 11020 | CTTGGTCATATAGTCAAACA | 43 | 280 |
| 388502 | 44 | 11140 | TAATCACAGGCTGCAAGCTC | 28 | 281 |
| 388503 | 44 | 11170 | AAGCAATCCATGGACTGAAG | 52 | 282 |
| 388504 | 44 | 11211 | GTCATGATGGAAAGATAGAG | 35 | 283 |
| 388505 | 44 | 11240 | AACCTTGCATCCCAGCAGCA | 12 | 284 |
| 388506 | 44 | 11300 | GGCAGATAGGAGGAGAGTCA | 19 | 285 |
| 388507 | 44 | 11407 | GGTGAATTTCTTTCATTAAA | 53 | 286 |
| 388508 | 44 | 11525 | TTGGACCAACCTCAGAGTGT | 45 | 287 |
| 388509 | 44 | 11560 | GTAATCAGGCCTGCACCATG | 41 | 288 |
| 388510 | 44 | 11575 | CATCTACCATGAGGAGTAAT | 15 | 289 |
| 388511 | 44 | 11611 | AATGGCTCTAGATTTTATAT | 33 | 290 |
| 388512 | 44 | 11678 | TTCTGATCACACTAAACAAG | 31 | 291 |
| 388513 | 44 | 11750 | CTAGGTTGTGGCACCCATGA | 47 | 292 |
| 388514 | 44 | 11766 | GTACCCAGGTGCATCTCTAG | 52 | 293 |
| 388515 | 44 | 11890 | TGTATGTGGCAGTTGCAAGA | 51 | 294 |
| 388516 | 44 | 11940 | ACTTTTAAAAATTGAGTCCC | 17 | 295 |
| 388517 | 44 | 12054 | TTAAATAAAGCTTGGAAATC | 8 | 296 |
| 388518 | 44 | 12132 | TGACAGTACCACCATGGAAA | 27 | 297 |
| 388519 | 44 | 12176 | GTGCATTGCCAAAAGTTCTA | 41 | 298 |
| 388520 | 44 | 12248 | AAGTCACCTACATGTCAAGG | 22 | 299 |
| 388521 | 44 | 12262 | ACTTGGCAGTGGCTAAGTCA | 21 | 300 |
| 388522 | 44 | 12377 | GTTAGGATTGGTCCCTTCCC | 18 | 301 |
| 388523 | 44 | 12527 | GACCAATTCTGCAGCCCCAC | 28 | 302 |
| 388524 | 44 | 12648 | CCATGATCCTAGTGCTCAAT | 42 | 303 |
| 388525 | 44 | 12696 | CCACATACCAATCCCTGGAG | 38 | 304 |
| 388526 | 44 | 12726 | CCAGCATCAGCAGCTCAGTG | 40 | 305 |
| 388527 | 44 | 12756 | TTTCCCAACCATGATATCCT | 7 | 306 |
| 388528 | 44 | 12846 | CCCTGAACCTTGATATCATC | 2 | 307 |
| 388529 | 44 | 12971 | TGCAGATAGGTCTCTGCCAC | 16 | 308 |
| 388530 | 44 | 13020 | TACAGCAGCAAGGCTTGGAC | 29 | 309 |
| 388531 | 44 | 13100 | GGAAATGGACAGCCAGGTCT | 44 | 310 |

Isis numbers 387865-387942 are targeted to both human and mouse huntingtin.

Example 4

Antisense Inhibition of Human Huntingtin in A549 Cells

Several antisense oligonucleotides were selected for additional testing in A549 cells. Cells in multi-well plates were treated with various amounts of the selected antisense oligonucleotides, as indicated in the following table (n=6 treatments per antisense oligonucleotide). Following the end of the treatment period, RNA was isolated from the cells, and human huntingtin mRNA levels in each individual cell culture well were measured by quantitative, real-time PCR. The data presented in the following table (Table 6) represent the average percent inhibition for each antisense oligonucleotide (n=6 treatments), relative to untreated cells. Control oligonucleotides, having randomized nucleotide sequences not targeted to any known gene, were also tested.

TABLE 6

Dose response inhibition of human huntingtin in A549 cells

| Isis No. | 6.25 nM | 12.5 nM | 25 nM | 50 nM | 100 nM | 200 nM |
|---|---|---|---|---|---|---|
| 387892 | 97 | 91 | 77 | 68 | 45 | 28 |
| 387898 | 85 | 86 | 69 | 47 | 35 | 21 |
| 387902 | 91 | 104 | 67 | 47 | 23 | 9 |
| 387916 | 88 | 100 | 100 | 51 | 32 | 19 |
| 388227 | 86 | 92 | 114 | 80 | 69 | 58 |
| 388240 | 117 | 126 | 83 | 65 | 24 | 22 |
| 388249 | 101 | 100 | 106 | 54 | 35 | 24 |
| 388816 | 101 | 132 | 77 | 59 | 38 | 26 |
| 388817 | 92 | 97 | 84 | 69 | 50 | 30 |
| 388824 | 78 | 87 | 85 | 69 | 41 | 27 |

TABLE 6-continued

Dose response inhibition of human huntingtin in A549 cells

| Isis No. | 6.25 nM | 12.5 nM | 25 nM | 50 nM | 100 nM | 200 nM |
|---|---|---|---|---|---|---|
| 388833 | 81 | 82 | 68 | 65 | 47 | 41 |
| Control #1 | 115 | 102 | 96 | 77 | 71 | 57 |

These results demonstrate that the antisense oligonucleotides targeted to huntingtin reduced huntingtin mRNA levels in A549 cells. The control oligonucleotides were not able to effectively inhibit huntingtin mRNA levels, particularly at lower doses. The target regions to which these inhibitory antisense oligonucleotides are complementary are herein referred to as "validated target segments."

Example 5

Antisense Inhibition of Human Huntingtin in HD Patient Cells

GMO4281

Several antisense oligonucleotides were selected for additional testing in GMO4281 fibroblasts, which originated from an HD patient. Cells in multi-well plates were treated with various amounts of the selected antisense oligonucleotides, as indicated in the following table (n=6 treatments per antisense oligonucleotide). Control oligonucleotides, having randomized nucleotide sequences not targeted to any known gene, were also tested.

Following the end of the treatment period, RNA was isolated from the cells, and human huntingtin mRNA levels in each individual cell culture well were measured by quantitative, real-time PCR. The data presented in the following table represent the average huntingtin mRNA level (n=6), relative to untreated cells, i.e. the data are expressed as percentage of control cell huntingtin mRNA levels. Percent control less than 100 indicates a reduction in huntingtin mRNA levels, whereas percent control greater than 100 indicates an increase in huntingtin mRNA levels. Percent inhibition can be calculated by subtracting the percentage of control from 100.

TABLE 7

Dose response inhibition of human huntingtin in GMO4281 fibroblasts

| Isis # | 9.375 nM | 18.75 nM | 37.5 nM | 75.0 nM | 150.0 nM | 300.0 nM |
|---|---|---|---|---|---|---|
| 387892 | 77 | 55 | 47 | 33 | 22 | 21 |
| 387898 | 77 | 61 | 49 | 25 | 17 | 13 |
| 387902 | 87 | 58 | 52 | 27 | 17 | 13 |
| 387916 | 104 | 75 | 50 | 25 | 14 | 12 |
| 388240 | 81 | 74 | 57 | 26 | 17 | 16 |
| 388249 | 96 | 74 | 55 | 32 | 18 | 14 |
| 388816 | 86 | 61 | 48 | 26 | 14 | 12 |

TABLE 7-continued

Dose response inhibition of human huntingtin in GMO4281 fibroblasts

| Isis # | 9.375 nM | 18.75 nM | 37.5 nM | 75.0 nM | 150.0 nM | 300.0 nM |
|---|---|---|---|---|---|---|
| 388817 | 84 | 76 | 51 | 35 | 26 | 18 |
| 388824 | 86 | 78 | 59 | 38 | 24 | 20 |
| 388833 | 84 | 79 | 60 | 33 | 19 | 13 |
| Control #1 | 99 | 95 | 106 | 67 | 63 | 48 |
| Control #2 | 100 | 102 | 88 | 77 | 64 | 49 |

GMO4478 Cells

Several antisense oligonucleotides targeted to huntingtin were selected for additional testing in GMO4478 cells, which are fibroblasts derived from and HD patient. The testing was performed according to the procedure used for GMO4281 cells. The results are shown in the following table as average percent inhibition, relative to untreated cells.

TABLE 8

Dose response inhibition of human huntingtin in GMO4478 fibroblasts

| Isis No. | 9.375 nM | 18.75 nM | 37.5 nM | 75.0 nM | 150.0 nM |
|---|---|---|---|---|---|
| 387892 | 45 | 29 | 17 | 10 | 7 |
| 387898 | 50 | 27 | 9 | 2 | 2 |
| 387902 | 40 | 22 | 9 | 3 | 2 |
| 387916 | 60 | 39 | 18 | 6 | 3 |
| 388240 | 60 | 34 | 16 | 5 | 6 |
| 388249 | 78 | 56 | 34 | 13 | 7 |
| 388816 | 75 | 48 | 26 | 8 | 7 |
| 388817 | 70 | 52 | 37 | 38 | 32 |
| 388824 | 65 | 42 | 21 | 9 | 8 |
| 388833 | 43 | 31 | 16 | 7 | 3 |
| Control #1 | 95 | 88 | 73 | 58 | 48 |
| Control #2 | 101 | 94 | 90 | 64 | 56 |

Each of the antisense oligonucleotides targeted to human huntingtin efficiently reduced huntingtin mRNA levels, in both GMO4478 and GMO4281 fibroblasts. The control oligonucleotides were not able to effectively inhibit huntingtin mRNA levels, particularly at lower doses.

The potency of antisense oligonucleotides targeted to huntingtin is summarized in Table 9. The potency is illustrated as $IC_{50}$, which is the concentration at which a 50% reduction in huntingtin mRNA levels is observed. This table also indicates the huntingtin sequence to which the antisense oligonucleotides are complementary, as well as the corresponding 5' target site. Particular features of the region of the huntingtin sequence to which the antisense oligonucleotides are complementary are also shown. Additionally indicated is the species of huntingtin gene to which the antisense oligonucleotides are targeted. The target regions to which these inhibitory antisense oligonucleotides are complementary are herein referred to as "validated target segments."

TABLE 9

Summary of potent antisense oligonucleotides targeted to huntingtin

| | | $IC_{50}$ | | Target SEQ ID | 5' Target | Target nucleic | Target region within human |
|---|---|---|---|---|---|---|---|
| Isis No | A549 | GM04281 | GM04478 | NO | Site | acid specifity | huntingtin gene |
| 387892 | 84 | 32 | 5 | 4 | 3209 | Human-Mouse | exon 23:exon 24 |
| 387898 | 47 | 31 | 8 | 4 | 4036 | Human-Mouse-Rat | exon 30 |

TABLE 9-continued

Summary of potent antisense oligonucleotides targeted to huntingtin

| Isis No | A549 IC$_{50}$ | GM04281 | GM04478 | Target SEQ ID NO | 5' Target Site | Target nucleic acid specifity | Target region within human huntingtin gene |
|---|---|---|---|---|---|---|---|
| 387902 | 39 | 35 | 5 | 4 | 4269 | Human-Mouse | exon 31 |
| 387916 | 61 | 42 | 13 | 4 | 5801 | Human-Rat | exon 42 |
| 388240 | 63 | 39 | 12 | 4 | 4558 | Human; >4 mm to rodent | exon 34 |
| 388249 | 63 | 45 | 24 | 4 | 6769 | human; >5 mm to rodent | exon 48:exon 49 |
| 388816 | 69 | 34 | 19 | 45 | 1650 | targets R6/2 insert; >5 mm to mouse | intron 1 |
| 388817 | 98 | 48 | 25 | 45 | 1670 | targets R6/2 insert; >5 mm to mouse | intron 1 |
| 388824 | 81 | 50 | 15 | 45 | 1817 | targets R6/2 insert; 5 mm to mouse | intron 1 |
| 388833 | 103 | 48 | 5 | 45 | 1128 | targets CAG repeat region | exon 1 |

As the antisense oligonucleotides reduced huntingtin mRNA levels in cells isolated from HD patients, the antisense oligonucleotides are candidate therapeutic agents for the reduction of huntingtin mRNA levels in vivo. In one embodiment, the antisense oligonucleotides, having demonstrated potency in vitro, are further tested in experimental animal models, including experimental models of Huntington's disease, to identify antisense oligonucleotides that may reduce huntingtin mRNA in humans. Accordingly, in one embodiment, the antisense oligonucleotides are administered at therapeutically effect amounts to a human, for the treatment or amelioration of Huntington's disease. In another embodiment, the antisense oligonucleotides are administered at therapeutically effective amounts, to delay the onset of Huntington's disease.

Example 6

Antisense Inhibition of Huntingtin in Neuronal Cell Lines

Several antisense oligonucleotides targeted to huntingtin were selected for additional testing in huntingtin neuronal cell lines. Mouse striatum cell lines with wild-type huntingtin, STHdhQ7/7 (Q7/7), and mutant huntingtin, STHdhQ111/111 (Q111/111) were transfected with various doses of oligos 387902 and 387916, ranging from approximately 0.05 µM, to 10 µM. A 200V, 2 msec pulse in a 2 mm gap cuvette was used for electroploration transfection. One million cells were electroporated in the presence of the indicated amount of oligonucleotide. Following electroporation, the cells were plated at a density of 5×10$^4$ cells per well. The results are reported in the Table 10 as percent huntingtin mRNA as compared to no oligo control, with each concentration performed in triplicate.

TABLE 10

Inhibition of huntingtin in mouse neuronal cell lines

| | Q7/7 | | Q111/111 | |
|---|---|---|---|---|
| [Oligo]µM | 387902 % mHtt | 387916 % mHtt | 387902 % mHtt | 387916 % mHtt |
| 0 | 100.0 | 100.0 | 100.0 | 100.0 |
| 0.675 | 85.9 | 36.5 | 156.4 | 59.3 |
| 1.25 | 50.2 | 34.5 | 103.4 | 31.4 |
| 3 | 31.4 | 11.0 | 38.9 | 18.8 |
| 5 | 12.2 | 1.6 | 16.5 | 6.4 |
| 10 | 5.5 | 2.7 | 6.8 | 3.1 |

In subsequent studies, cells are evaluated for phenotypic response by measuring caspase activity using the Promega Apo-ONE® Homogeneous Caspase-3/7 commercial assay. Briefly, cells are plated and Lipofectin® transfected the next day. After 48 hours the media is changed to serum-free DMEM for 24 h prior to the caspase assay.

Example 7

In Vivo Antisense Inhibition of Huntingtin

In order to evaluate the effects of antisense inhibition of a gene in the central nervous system, it is beneficial to deliver antisense oligonucleotides directly to the central nervous system, for example, by intracerebroventricular (ICV), intrathecal (IT), or intraparenchymal administration. To evaluate the effects of antisense inhibition of huntingtin in the central nervous system of animals, antisense oligonucleotides targeted to huntingtin were administered to mice via ICV delivery.

ISIS 387902, 387916, 387918, 388249, 388503, 388509, and 388816 were selected for in vivo testing. Saline-treated mice were used as control animals. Each treatment or control group included four animals. Surgically implanted Alzet mini-pumps continuously infused antisense oligonucleotides into mice at a dose of 100 ug/day over a two-week period. During the treatment period, mice were monitored for any clinical changes, such as body weight changes. At the end of the treatment period, mice were sacrificed and major organs were isolated. RNA was prepared from brain and liver tissues, and subjected to quantitative real-time PCR analysis to measure the reduction in mouse huntingtin mRNA levels.

Each antisense oligonucleotide targeted to huntingtin reduced huntingtin mRNA levels in mouse brain, as shown in the following table. The species of huntingtin nucleic acid to which each antisense oligonucleotide is targeted is also shown. Mouse huntingtin mRNA levels represent the average for each treatment group and are expressed as percentage of saline control (% saline control).

TABLE 11

In vivo antisense inhibition of mouse huntingtin

| Isis No. | SEQ ID NO: | Huntingtin nucleic acid target species | Huntingtin mRNA levels, % of saline control |
|---|---|---|---|
| 387902 | 105 | human, mouse | 37% |
| 387916 | 125 | human, rat (single mismatch to mouse) | 32% |
| 387918 | 127 | human, mouse, rat | 35% |
| 388503 | 282 | mouse | 30% |
| 388509 | 288 | mouse | 34% |

Each of the antisense oligonucleotides shown in Table 11 reduced huntingtin mRNA levels in mouse brain following the ICV infusion period. Furthermore, ISIS 387916, which has one mismatch to mouse huntingtin, was able to reduce mouse huntingtin mRNA levels in vivo.

Example 8

In Vivo Antisense Inhibition in Models of Huntington's Disease

To evaluate the effects of antisense inhibition of huntingtin in the central nervous system of an animal model of HD, antisense oligonucleotides targeted to huntingtin are administered to R6/2 transgenic mice via ICV delivery.

ISIS 387902, 387916, 387918, 388249, 388503, 388509, and 388816 are selected for in vivo testing. Saline-treated mice are used as control animals. Each treatment or control group includes four animals. Surgically implanted Alzet mini-pumps continuously infuse antisense oligonucleotides into mice at a dose of 100 ug/day over a two-week period. During the treatment period, mice are monitored for any clinical changes, such as body weight changes as well as phenotypical behaviors related to the huntingtin transgene. At the end of the treatment period, mice are sacrificed and major organs are isolated. RNA is prepared from brain and liver tissues, and is subjected to quantitative real-time PCR analysis to measure the reduction in mouse huntingtin mRNA levels. Huntingtin protein expression in the tissue is also measured using standard Western blotting techniques.

Example 9

Administration of Antisense Oligonucleotides to Individuals Suffering from Huntington's Disease Provided herein are methods of treating an individual suffering from Huntington's Disease (HD). Such methods comprise the administration to the cerebrospinal fluid or brain tissue of the individual a pharmaceutical composition comprising an antisense oligonucleotide targeted to huntingtin. Delivery of the pharmaceutical composition to the cerebrospinal fluid allows for contact of the antisense oligonucleotide with the cells of central nervous system tissues, including tissues affected by HD.

Individuals suffering from HD receive a diagnosis of HD from a physician. The physician's assessment includes the genetic testing of the HD gene, and a neurological examination.

A surgically implanted pump (e.g, a Medtronic SyncroMed® II pump) is used to deliver a pharmaceutical composition comprising an antisense oligonucleotide targeted to huntingtin to the cerebrospinal fluid or brain of an individual suffering from HD. The pump is surgically implanted per the procedures outlined by the manufacturer. Drug is retained in the reservoir of the pump, and is pumped at a programmed dose preferably into a catheter that is surgically intrathecally implanted.

The reservoir is loaded with a pharmaceutical composition comprising an antisense oligonucleotide targeted to huntingtin. The pharmaceutical composition is administered at an amount that yields an infusion of 8 mg to 12 mg of antisense oligonucleotide into the cerebrospinal fluid. In some embodiments, the amount of antisense oligonucleotide infused is 10 mg. Administration is for a period of at least 28 days. Individuals are monitored by a medical professional, who evaluates indicators of HD. It is clinically desirable for the administration to slow or halt the progression of HD, or prevent or slow the worsening of, or improve, a symptom or marker of HD.

Example 10

Administration of Antisense Oligonucleotides to Individuals Susceptible to Huntington'S Disease Provided herein are methods of preventing or delaying the onset of Huntington's Disease (HD) in individuals susceptible to HD. Such methods comprise the administration to the cerebrospinal fluid or brain of the individual a pharmaceutical composition comprising an antisense oligonucleotide targeted to huntingtin. Delivery of the pharmaceutical composition to the cerebrospinal fluid allows for contact of the antisense oligonucleotide with the cells of central nervous system tissues, including tissues affected by HD.

Individuals susceptible to HD are identified by a physician following genetic testing of the HD gene, and a neurological examination.

A surgically implanted pump (e.g, a Medtronic SyncroMed® II pump) is used to deliver a pharmaceutical composition comprising an antisense oligonucleotide targeted to huntingtin to the cerebrospinal fluid or brain of an individual susceptible to HD. The pump is surgically implanted per the procedures outlined by the manufacturer. Drug is retained in the reservoir of the pump, and is pumped at a programmed dose preferably into a catheter that is surgically intrathecally implanted.

The reservoir is loaded with a pharmaceutical composition comprising an antisense oligonucleotide targeted to huntingtin. The pharmaceutical composition is administered at an amount that yields an infusion of 8 mg to 12 mg of antisense oligonucleotide into the cerebrospinal fluid. In some embodiments, the amount of antisense oligonucleotide infused is 10 mg. Administration is for a period of at least 28 days. Individuals are monitored by a medical professional, who evaluates indicators of HD. It is clinically desirable for the administration to prevent or delay the onset of symptoms of HD.

SEQUENCE LISTING (369 sequences)

SEQ ID NO: 1 - DNA, 11155 bp, Homo sapiens
taatggagagcttgacctcatctgataccttcactgaaggaaacaacttagtgtcttttgtgttgaacactgaggtaaaaaattggaatagttgattatatgaactctgctaaaattgagtgcattttacattttttaaggccttgttgggccctggttaaataattatttttaaaaatccttaaggagcctattataaacagatctgtggtcttaatgaaatgtgattaatactgtgcattattttaagaacttttgacttttcaaaaaacttttacaacatttcccatttgatagcggcataggtttaagcacttctcatctctaagttagtggacaaaaaaccctcatggatagtctaataatgtttgctacaagtccatgttgagttttatactccattttattttcagttttaaaaactgtggttaaatatgtgtaacataaaatttatgttcttaaccattttttgcgtatacagttcgctggtattaaatacatttaaataatgtcatggaatcattgctaccacccatctctgtaaccttttgatcatgtaacactgaagctctgttcccattgaactctattcctcctttcccgccaagtccctggcaaccacgattcttctttctgtcttctgaatttgactactttgggttctcatatactttaggagtcacacagtatttgttttacttagcataatgtccccaaagctcatgcatgttgtagcctatgttagaacttcctaatgtttcaggccaaatactattccattgtatggataggccacattttgcttttccattcctctgtccatggacacttgtattgcttcatgttttagccattgtgaatcatgctgttatgaacgtgggtgtacagatagctcctggagactctgctttccatttttttggctaaatacccagaaatggagttgcttttacattccaattttaatttaaaacattcatatcattgagtgttttacttaatagtatagtagttaacaaacttaataaaatagtattttggtaataatttgctggtagtccattgttcagtttttttaggtaaattacacaggacatttcaagtggacatgaaacatcttgtgatgtggaatcatgccccaagctgatggctaaacatatgaaataccataccctaaatttagtagatttagtctttgcaatttaggagataacctgttatattgttaggtttttgtcgaaaagctttgtcctcatatttccaacttgctgtaaaatttgtttgtgaagacaaatatttttgtatgggttttttctttttcatattaaaaagaaatgtccacattggaatttttttggagtttttagagctaatagagcttttcataatgtagtgggaatgagtgatcagtaagctcttagcagtttccatgcgtgcatttctgtgccttgaaataaatgacagatgagtacatttgtgttctgtgtgtaaaatgtgctctttcctcattgcacttccatgttggagggcttgtctcttggtgatcacacttcaaaattctcacagccccccttgaaccgtttaggtgttagacggtaccgacaaccagtatttgggcctgcagattggacagccccaggatgaagatgaggaagccacaggtattcttcctgatgaagcctcggaggccttcaggaactcttccatgggtatgtggactacaggtgatgcgctacaaagtggtttgtattcagacctggacatcttaattatatctttgcttccaagaagaagtcctttgatactgttttctgagttctgaatagctgatgaaaatgaccaattgaggaataatcatactttttcttgatctaaatcttatacttttgagttatcttagcataaatgtataattgtattttaagtggaaatttgtcacttaatcttgatttctctgtttttaaagcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttcttcgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtatgctttctatctgagcctataactaacccatgccttttgggaagtcacgtgatgtttcacagtcagtaagtctggaataatacctggtcttgcttcacttctgagttgggtaaagaagtctgtatcagtgtaattttctaatccgtcctgcattatctatggctcttggttcatacctgtcttgaagttctgtcatgttctgtctcttgtcctcagtagagatgctacagcagtggctcgcctcaggcagggcagggcagtggggtggctgtcctgggggcaggcagtaggggcacgctgacgtcagggaagttgaaacccaagagaagccagtaaaagtgagtctcagattgtcaccatgtgctggcagttttacacgctgtcagtaataaaaatcttctccctgcagggcagcctgcctccaataaatacgtgtagtatcaaatcctgtcttccctcataaattgtttggaagctccccaaggacagtgatgaggcactcgtaagtgcttgctgcctagatgggtccctctccacctttgctagattctgagcattcactgagttagagctgcttctgcaaatgtgctgcttctgctaagtggctgtgacttcatgcagccttcacttggtttgtcatcagtggagatgccctgtgttgtcgaaggagataagcccagtaagcctgctgggcaccttttggtttgcaggttcagcaggcagcccatggctttccctgtgtcgcattgaagcagctggctaaaattgatgatacattaaattcctgtgacagatgatcagcttgtatttgtgtaatggtgtacagttcacaaagcttaaaaaaatgctacctgccatttcatcctcagcgaggaaggtgatacacagagagaccaagtgactgtgtccacggcgacggcgctctgcatttcactttagcggttaatgtactctacctatatttttactttatatttaccatatatcttttcatgtatacttggcgtaagtgctttatagtagtcacctaattcactgtcatcttttttgtttcttggaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagcatggcccagttgccaatggaagaactcaacagaatccaggaataccttcagagcagcgggctcgctcagaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagaaccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatccactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctcaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctgcagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcatcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttacagctgctcttgcatctgggccagaagtcctccctcctgcaggctgggtgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtagctgggggtgctagacacccggcaccattctcccttctctcttttcttctcaggatttaaaatttaattatatcagtaaagagattaattttaacgt

SEQ ID NO: 2 - DNA, 916 bp, Homo sapiens
acctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttataggcaagttattagcaaggtctactcttacaattaactttgcagtaatactagttacactctattgattatgggcctgccctgtgctaagcagtctgcattccatcttccttgccaaaacttataatacaaatttcatctttatcttatacatagggggaagttgggctagggtgtggtaggctcacgcctgtaatttcagcactttggaaggatcgcttcaggccaggagtttgagacaacctggccaagtgagacctgtctctacaaaaaaaaaaaaaaaaaacccgggctctttttccggctgcggcaaacacgaggtatacacatcggcctggccttgtcgtttctcgacccctttctgtccagggggaatccgcggtccaaaggaggcgataatccaaccggcagaaataaa

SEQ ID NO: 3 - DNA, 10348 bp, Homo sapiens
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcacgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctcaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgtgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgt

SEQ ID NO: 4 - DNA, 13495 bp, Homo sapiens
gctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctcaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattcttccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgcggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatcaaaaaaaaaaaaaaaaaa

SEQ ID NO: 5 - DNA, 172001 bp, Homo sapiens
cctgcaggggcctctccagctcactgggggtggggtgggggtcacacttggggtcctcaggtcgtgccgaccacgcgcattctctgcgctctgcgcaggagctcgcccaccctctccccgtgcagagagccccgcagctggctccccgcagggctgtccgggtgagtatggctctggccacgggccagtgtggcgggagggcaaaccccaaggccacctcggctcagagtccacggccggctgtcgccccgctccaggcgtcggcgggggatcctttccgcatgggcctgcgcccgcgctcggcgccccctccacggccccgccccgtccatggccccgtccttcatgggcgagcccctccatggccctgcccctccgcgccccacccctccctcgccccacctctcaccttcctgccccgcccccagcctccccaaccctcaccggccagtcccctcccctatcccgtccgcccctcagccgccccgcccctcagccggcctgcctaatgtccccgtccccagcatcgccccgccccgcccccgtctcgccccgcccctcaggcggcctccctgctgtgccccgccccggcctcgccacgcccctacctcaccacgccccccgcatcgccacgccccccgcatcgccacgcctcccttaccatgcagtcccgccccgtcccttcctcgtcccgcctcgccgcgacacttcacacacagcttcgcctcaccccattacagtctcaccacgccccgtcccctctccgttgagccccgcgccttcgcccgggtggggcgctgcgctgtcagcggccttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcagcgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccgtgagtttgggcccgctgcagctccctgtcccggcgggtcccaggctacggcggggatggcggtaaccctgcagcctgcgggccggcgacacgaacccccggccccgcagagacagagtgacccagcaacccagagcccatgagggacacccgccccctcctggggcgaggccttcccccacttcagccccgctccctcacttgggtcttcccttgtcctctcgcgaggggaggcagagccttgttggggcctgtcctgaattcaccgaggggagtcacggcctcagccctctcgcccttcgcaggatgcgaagagttggggcgagaacttgtttctttttatttgcgagaaaccagggcgggggttcttttaactgcgttgtgaagagaacttggaggagccgagatttgctcagtgccacttccctcttctagtctgagagggaagagggctgggggcgcgggacacttcgagaggaggcggggtttggagctggagagatgtgggggcagtggatgacataatgcttttaggacgcctcggcgggagtggcggggcagggggggggcggggagtgagggcgcgtccaatgggagatttcttttcctagtggcacttaaaacagcctgagatttgaggctcttcctacattgtcaggacatttcatttagttcatgatcacggtggtagtaacacgattttaagcaccacctaagagatctgctcatctaagcctaagttggtctgcaggcgtttgaatgagttgtggttgccaagtaaagtggtgaacttacgtggtgattaatgaaattatcttaaatattaggaagagttgattgaagttttttgcctatgtgtgttgggaataaaaccaacacgttgctgatggggaggttaattgccgagggatgaatgaggtgtacattttaccagtattccagtcaggcttgccagaatacggggggtccgcagactccgtgggcatctcagatgtgccagtgaaagggtttctgtttgcttcattgctgacagcttgttactttttggaagctaggggtttctgttgcttgttcttggggagaatttttgaaacaggaaaagagagaccattaaaacatctagcggaaccccaggactttccctggaagtctgtgtgtcgagtgtacagtaggagttaggaagtactctggtgcagttcaggcctttctcttacctctcagtattctatttccgatctggatgtgtcccagatggcatttggtaagaatatctctgttaagactgattaatttttagtaatatttcttgttctttgtttctgttatgatccttgtctcgtcttcaaagtttaattagaaaatgattcggagagcagtgttagcttatttgttggaataaaatttaggaataaattattctaaaggatggaaaaactttttggatatttggagaaattttaaaacaatttggcttatctcttcagtaagtaatttctcatccagaaatttactgtagtgcttttctaggaggtaggtgtcataaaagttcacacattgcatgtatcttgtgtaaacactaaacagggctcctgatgggaaggaagacctttctgctgggctgcttcagacacttgatcattctaaaaatatgccttctctttcttatgctgatttgacagaacctgcatttgcttatcttcaaaatatgggtatcaagaaatttcctttgctgccttgacaaaggagatagattttgtttcattactttaaggtaatatatgattaccttatttaaaaaatttaatcaggactggcaaggtggcttacacctttaatccgagcactttgggaggcctaggtggacgaatcacctgaggtcaggagtttgagaccagcctggctaacatggtgaaaccctgtctctactaaaaatacaaaaattagctggtcatggtggcacgtgcctgtaatccaagctacctgggaggctgaggcaggaaaatcgcttgaacccgggaggcagagtctgcagtgagttgagatcacgccactgcactccagcctgggtgacagagcgagactctatctcaaaaaaaattttttttaatgtattatttttgcataagtaatacattgacatgatacaaattctgtaattacaaaagggcaataattaaaatatcttccttccacccctttcctctgagtacctaactttgtccccaagaacaagcactatttcagttcctcatgtatcctgccagatataacctgttcatattgtaagatagatttaaaatgctctaaaaacaaaagtagtttagaataatatatatctatatattttttgagatgtagtctcacattgtcacccaggctggagtgcagtgatacaatctcggctcactgcagtctctgcctcccaggttcaaatgcttctcctgcctcagccttctgagtagctgggattacaggcgcccaccaccatgtccagctaatttttgtatttttagtagagatggggtttcaccatgttggccaggctggtcttgaactcctgaccttgtgatctgtccacctcggcctcccaaagtgctgggattacaggtgtgagccaccatgcctggctagaataataacttttaaaggttcttagcatgctctgaaatcaactgcattaggtttatttatagttttatagttattttaaataaaatgcatatttgtcatatttctctgtattttgctgttgagaaaggaggtattcactaattttgagtaacaaacactgctcacaaagtttggattttggcagttctgttcacgtgcttcagccaaaaaatcctcttctcaaagtaagattgatgaaagcaatttagaaagtatctgttctgtttttatggctcttgctctttggtgtggaactgtggtgtcacgccatgcatgggcctcagtttatgagtgtttgtgctctgctcagcatacaggatgcaggagttccttatggggctggctgcaggctcagcaaatctagcatgcttgggagggtcctcacagtaattaggaggcaattaatacttgcttctggcagtttcttattctccttcagattcctatctggtgtttccctgactttattcattcatcagtaaatatttactaaacatgtactatgtgcctggcactgttataggtgcagggctcagcagtgagcagacaaagctctgccctcgtgaagctttcattctaatgaaggacatagacagtaagcaagatagataagtaaaatatacagtacgttaatacgtggaggaacttcaaagcagggaaggggatagggaaatgtcagggttaatcgagtgttaacttatttttatttttaaaaaaattgttaagggctttccagcaaaacccagaaagcctgctagacaaattccaaaagagctgtagcactaagtgttgacatttttattttattttgttttgttttgttttttttgagacagttcttgctctatcagccaggctggagtgcactagtgtgatcttggctcactgcaacctctgcctcttgggttcaagtgattctcatgcctcagcctcctgtttagctgggattatagacatgcactgccatgcctgggtaattttttttttttcccccgagacggagtcttgctctgtcgcccaggctggagtgcagtggcgcgatctcagctcactgcaagctccgcttcccgagttcacgccattctcctgcctcagtctcccaagtagctgggactacaggcgcctgccaccacgtccagctaatttttttgtatttttaatagagacggggtttcaccgtgttagccaggatgatcttgatctcctgacctcgtcatccgccgaccttgtgatccgcccacctcggcctcccaaagtgctgggattacaggcatgagccactgtgcccggccacgcctgggtaatttttgtatttttagtagagatggggttttgccatgatgagcaggctggtctcgaactcccggcctcatgtgatctgcctgccttggcctcccaaagtgctaggattacaggcatgagccaccatacctggccagtgttgatattttaaatacggtgttcagggaaggtccactgagaagacagctttttttttttttttttttggggttggggggcaaggtcttgctctttaacccaggctggaatgcagtatcactatcgtagctcacttcagccttgaactcctgggctcaagtgatcctcccacctcaacctcacaatgtgttgggactataggtgtgagccatcacacctggccagatgatggcttttgagtaaagacctcaagcgagttaagagtctagtgtaagggtgtatgaagtagtggtattccagatggggggaacaggtccaaaatcttcctgtttcaggaatagcaaggatgtcattttagttgggtgaattgagtgagggggacatttgtagtaagaagtaaggtccaagaggtcaagggagtgccatatcagaccaatactacttgccttgtagatggaataaagatattggcatttatgtgagtgagatgggatgtcactggaggattagagcagaggagtagcatgatctgaatttcaatcttaagtgaactctggctgacaacagagtgaaggggaacaccggcaaaagcagaaaccagttaggaagccactgcagtgctcagataagcatggtgggttctgtcagggtaccggctgtcggctgtgggcagtgtgaggaatgactgactggattttgaatgcggaaccaactgcacttgttgaactctgctaagtataacaatttagcagtagcttgcgttatcaggtttgtattcagctgcaagtaacagaaaatcctgctgcaatagcttaaactggtaacaagcaagagcttatcagaagacaaaaataagtctggggaaattcaacaataagttaaggaacccaggctctttcttttttttttttttgaaacggagtttcgctcttgtcacccgggctggagtgcaatgatgtgatctcagctcactaaaacctctacctcctgggttcaagtgattcttctgcctcagcctcccaagtaactgggattacaggcgtataccaccatgcccagctaatttttgtgtttttagtagagatggggtttcaccatgttggccaggctggtctcgaacttctgacctcaggtgatccactcgcctcagcctgccaaagtgctgggattacaggtttgggccactgcacccggtcagaacccaggctctttcttatacttaccttgcaaacccttgttctcattttttccctttgtatttttattgttgaattgtaatagttctttatatattctggatactggattcttatcagatagatgatttgtaaaaactctcccttcctttggattgtctttttactttcttgatagtgtcttttgaagtgtaaaagtttttaattttgatgaagtcgagtttatctattttgtctttggttgctgtgcttcaagtgtcatatctaagaaatcattgtctaatccaaagtcaaaaaggtttactcctatgttttcttctaagaattttagagttttacatttaagtctgatccattttgagttaatttttatatatggttcaggtagaagtccaactttattcttttccatgtggttattcagttgtcccagcactgtttgttgaagagactattctttccccatggaattatcttagtacccttgttgaaaattaatcgtccttaattgtataaatttatttctagactgtcagttctacctgttggtctttatgtcgatcctgtgccagtaccatacagtcttgattactgaagtttgtgtcacagtttaaattcatgaaatgtgagttctccaactttgttccttttcaagattgatttggccatgctgggtcccttgcatttccgtacgaattgtaggatcagcttgtcagtttcaacaaagaagccaagtaggattctgagagggattgtgttgaatctgtagatcaacttggggagtattcgcatcttaacaatattgtcttccacctatgaacatgggcaaactttgtgtaaatggtcagattgtaagtatttcgggctgtgtgggcacagtgtctctgtcacagctacgcggctctgccattgtagcatgaaagtagccataagcaatatgtatgagtgtctgtgttccaatagaattttattaatgacaaggaagtttgaatttcatataattttcacctgtcatgagatagtatttgattattttggtcaaccatttaaaaatgtaaaaacatttcttagcttgtgaactagccaaaaatatgcaggttatagttttcccactcctaggttaaaatatgataggaccacatttggaaagcatttctttttttttttttttttttttttttgagacggagtttcactcttgttgcccaggctggagtgcagtggcgcgatctcggctcactgcaacctctgcctcccaggttcaagacattctcctgcacggcctccctagtagctgggattacaggcatgcgccaccacacccagctaattttgtatttttagtagagacggggtttctccatgttggtcaggctggtcttgaactcctgacctcaggtgatccacccgcctcagcctcccaaagtgctgggattacagggtgtgagccaccacaccctgctggaaagcatttcttttttggctgtttttgttttttttttaaactagttttgaaaattataaaagttacacatatacattataaaaatatcttcaagcagcacagatgaaaaacaaagcccttcttgcaagtctgtcatctttgtctaacttcctaagaacaaaagtgtttcttgtgtcttcttcccagattttaatatgcatatacaagcatttaaatgtgtcattttttgtttgcttgactgagatcacattacatatgtatttttttacttaacaatgtgtcatagatattgttccatagcagtacctgtaattcttattaattgctatgtaatattttagaatttctttttaaaagaggacttttggagatgtaaaggcaaaggtctcacatttttgtggctgtagaatgtgctggtgacatattctctctaccttgagaagtccccatccccatcacctccatttcctgtaaataagtcaaccacttgataaactacctttgaatggatccacactcaaaacatttagtcttattcagacaacaaggaggaaaaataaaataccttataaagcactgtttaatattgtattaaattggatcaatttgggggctagaatgtatgttagagacatgatatgtccataggtccttgctatcacagtgaggtctcagggacagtcgtttggtatcatttgggatctcataagcagactctctctgcttgacctgacaaatcagagtctgtgttttaacaggttcagtgagtgacttacatgcacattggagtttgggaagctccactgtaggtgcttagaccttacctttgttgttgctaataacaatgcaagcatttgggaggaagacctgtgttgctcatatgtgtccaggtgtagctgaggtggccttgcttatctgctgtagggccgttgagcatttctgtagctgtgatgagtgagctgaggtgagcctgcggagagctcccagccattggtagtgggactcgcttagatgaactggaaggaccctttcatctgagcagccactatggagaaaaacaaccgaatgaggggagagacaatgtgcaattttatttagggcacaaaggagagctgtggttagaaggtgacatttgagtggaaagggggcaagccatgtgtatagcgggagaagagaggtccaggcagagttaacagaaggcagaaatgctttccatgtttgagaaccagtaaggaggccagtggctgaagtaaggtgaagggcagaaataaggatgaggctgcgagagatgagaggttagagacgagcgtcttgtgcaccaagataagcttgtgtggtcaaaacaagtagtttaatttatgtttttaaaagatcattttggctgggcacaatggttcatgcctgtaataccagtagtttgagacggtgtggtgggaggattgcctgaggccagacgaccagcatagccaacatagcagcacctataaggtctctacaaaaaactttaaaaaattagctgggcatagtggtgtgtgcctgtagtcccagctactcaggaggctgaggaggctggaggattgcttgagtccaggagtttgaggctgcagtgagctatgattatgccactacactacaacctgggcaagagagtgagaccctgtctctaaatatacacacacacacacacacacacacacacacacacacacacacacacacacacacacatatatatgtatatatatgcatttagatgaaaagatcactttgacaataccacatgctggtgaggatttagaaaaactaggtcacttattgctggtgggaatataatatagtacggccactctggaaaacagtttggcagtttgtcataaaactgaacataccgttagtatacagcccagcagcaactacaatcctgggcattaatcctagagaaatgaaaccttaatgttcacataaaaacctatactcaagtatgcatagcagctttacccataatatctaagaactggaatcagctcagatgtccttcaacaggtgaatggttaaactactcagtaataaaaaggaatgagctactgatagcatgcaacagtttaggtgaagttatgctaatgaaaaaagccaatcccaaaaggttatacatactgtatgattctatgtttttttgcaatggcacagttttagggatggagaatagattagtggttgcctggggttagagatggggtagtagagtaggttagtggtggcagaggagagaaaagagagggaggtgaatgtggttataaaaggacaacacaggggaatacttgtaatggaaatgctttgtctttttttttttttttttttttttggcgacagagtcttgctctgttgcccaggctggagtgcagtggcatgatcttttctcactgcaacctctgcctcctgggttcaagtgatacttgtgtctcagtctcccatgttcagagtgaaacaaaccagaggtaatgttcatccaaataatccaacacacatgacattaaaacatcaagatcaggtcggacgtggtggctcatgcctgtaatcccagcacttttgggaggccaaggtgggcagatcacttgaggtcaggagttcgagaccagccgggccaacatgatgaaaccccatcttgactaaaaatacaaaaattagccgggcatggtggtgtgcacctgtagtcccagctacttgggaggctgaggcaagagaactgcttgaacccgaggggcagaggttgcagtgagctgagagtgcgccattgcacttcagcctgtgtgacagagtaagactccatctccaaaaaaaaaaaaccaagatcaattaaaatacagcattactgggccgggtgtggtggctcacacctgtaatcccagcactttgggaggccgagatgggcagatcacgaggtcaggagatccagaccatcccggctaacacggtgaaaccccgtctctactaaaaaatacaaaaaattagccgggtatagtggtgggtgcctgtagtcccagctacttgggaggctgaagcaggagaatggtgtgaacccgggaggcagagctggcagtgagctgagatcgcgccactgcactccagcctgggcgacagagcaagactccgtctcgggggaaaaaaaaaaataaataaatagaatgctgtagtgtccttgagtttacatgcccctccttacgcttgtgtgcccgtgcagattgcttgattacacaattagaggaggctggcggaggattgttttaatttttttttttttgagacagtctggctctgttccccaggctagagtgcaatggcgcaatcttggtgcactgcaacctctgcctcctgggttcaagcagttcttctgccgcagcctcccgagtagctgggattataggcgcccgccaccacgcccaactattttttgtatttttagtagagcagcgtttcaccatgctggccaggctggtctcgaactcctgacctcagatgatctgctgccccagcctcccaaagtgctgggattacaggcgtgagccacacctggccgtttgttttaattttgaaggtgaagtgaaagtgactacatttaccaaaagtgattgaaaagccaggactgttcttaccctgtttttccagttcttgctcagagcaaggtggtttctttttcacttaatcaccatacttacttttcatgtagaacaagtcagtttgagttatcagttcatcatcttaactaaattccatgggggaaggaattagttttagtttcttaaacttccaggtttgcttattggacaaaatgagatagcaaggcagtgtttttaagttagattttttatttctttggtaatacaattttctcagaaacttagtagtcttttagtttagttgtttttagttggtcctatgttttggatcacccctctctactttattttgatagtgccaactgtgaagacatctgaagccataggtttggatgggaaggaggcatctttagcctgatcatcttcgccaggctgtttatctccttttgcttggctgagaagtcttaataggaggcttattcccagctatttggggacatagaagcagttagccattgcttatattttactgaggtctgtgtggtatgttgattgtagtcagttaacgattttgagaactgaaggcagcctggtatatatagagtaggtattagactgtgtttcttctaattgaatttcccatctcttgtaatctatgccatcatcttctgtactgctgagaaagaaagaaagtttctaatcaaactataccactggttgtaagatgcagtttggctttagtgatgttaacacatgattcaaacgtgaaattgattgagtattggtgaaatacagaggagatttaaagccagaagacctgggtttaaatgctggctgtatgacttcatatctgtgtgatcttgggcatgtcatggttggcacttcaatttcttctctctataatgggggaagtgaggccagtcatggtggctcatacctataatcccagtgctttgggaggccaagatgggaagatcgcttgaggccaggagtttgagcaattgggcaacatcgtgaggccccgtctctacaaaatattttgaaaaaattagccaggcccagtggtgcgtgcctgtggtccgcgccactcaggaggctgagacgggaggatcctttcagcctaggagtttaaggctaaagtgagccatgattgtgctatcgtactccagcctgggcagcagagcaagatcctgactctaaaaaaaagtaaaataaagtaaaatgggggaaatgaactgctttagtaacatcatctgttttttctgtgagcagcgtagcttgacagccattggtgaactcgtgccctgtgcttccctgtccagatccccattctgcccgcaacatggagtataacggtttattcatagtagtcgagaaacactcactgaatgaatgaatgaggtgtagaactaagtggagtgggtaattcaacacatattaatttccttcttttttttatttttagaaagaaagaactttcagctaccaagaaagaccgtgtgaatcattgtctgacaatatgtgaaaacatagtggcacagtctgtcaggtaattgcactttgaactgtctagagaaaataagaactttgtatattttcagtcttaatgggctagaatattctttgtgtcccagctattttaaatggattcagaaatccatttaagatgaagaaggacccttttcccatatttctggctatatacaaggatatccagacactgaaatgaataatgttccctttttgtaatcttttatgcaaaaattaaaaccattatggtaattgaacaacatgtttatgtttagttaacacccttagcaactatagttattttaaaaccatctatggtttgatatttttgcatttgttgcaatagtaggaacagcacaagacagttcagtttgtctctcttatttgctttttcttggcagtttgctgtcctattgtacctctgctcctagcagtggctggagcccactcctctgtgcttcgggattagtggggatcgtggggcattgactgtaggtcagctttccttgcttgatctttctcactgggatgaactagcagcaccttcttttgtagctgctttgcttttgactatctttctgaccgttgttcctagtagctgtagatggtaaatatatttaggcctgtttccaatggctcagtaggagacatattcacctatgatatctgaattctgttacccacatgggcatgcgtgaaatagttgccttgccttactttcccttggaataaataattcatgttattctcctggtagaagctagaaaaagcctttatagtcagtcagaaaaaaatttttagacaaataatcttgattttagtactgacaaaaacgtgtggtgattctttttttaatttttttttgagacggagtttcactcttgttgcccaggctggagtgcaatggcgtgatctcggctcactgcaacctctgcctcctgggttcaagtgattctcctgcctcagcctcccaagtagctggagttacaggcatgtgctactgtgcccagctaattttgtatttttagtagagatgttggtcaggctgatctcgaactcccaaccttaggtgatctgcccgcctcagcctcccaaagtgctgggattacaggcgtgagccagggcgcccggtgattcatttgttttttcaaaaaatttcctcttggccattgcttttcacttttgttttttttttttttttgagacggagtcacgatctgtcacccaggctggagtgcagtggcatgatcttggcttactgcaagctctgcctcccaggttcacgccattctcctgcttcagcctggcgagtagctgggactacaggtgctcgccaccacacccggctaattttttgtatttttagtagagatggggtttcaccgtggtcttgatctcctgacctcatgacccgctcaactcagcctcccaaagtgctgggattacaggcgtgagccaccgcgcccggccctctcttgtctttttattgtggtaaaatgcacataaaattgactgtcttaaccatttttaggggtacagttcagtatatatattcgtaatgttgtacagccatcactgccatctacttcataagtttttcttctgtcaaaactgaacatctgtcttcattaaactccctatcatccattctttcctgtagtccctttctactttctgtctgtatgagtgtaactgctctggagacctcatgtaagtggattcctacaggatttgtgttttttttttggtgatctgcttatttttaatgcctctgtgcatttgtattatatactttcaaagtgatttcacaaaaccgtttcattttaggttaactcatttctgttgtttgtgaaatactgtgtatgattctgttctgtttctgtctaatttgtggaaatgttgtgggaagaaaatgaaataacaaatgagcatatgtcctgaaaataaaaatataaaaattctaagttagcatgctattgtagaatacaacgctatgataaaagtaggaaaaaaaaaggtttgaattctatctctgctacctgtgtaagctgggtgactttagataagctgtaacgtgtttgagccttactggctcatttttgaaatgtaatccctagttacacagttcttgtgggatcagatggtacatgtgaaacactgtgaaaaagcaactgcatagatatgttcattagccacctgagcgggaagcgtatcccattgcgatgcccatcatccaaagctatatgttatctttacttttttttttttgagacagagtcttgctctgttgcccaggctagagtgcagtggtgcaatctcagctcactgcaagctccacctcccgggttcacgctattctcctgccccagcctcccaagtagctgggactacaggcacccgccaccatgcctggctaaatttttgtatttttagtagagatggggtttcaccgtgttagccaggatggtcttgatctcctgacctcgtgatccgcccgcctcggcctcccaaagtgctgggattacaggcgtgagccactgcccctggccatctttactttttttgtgaaatgactttaaatacttggcaaacatttggtcattgttcatctgatctccaccatccaggtctcagagaacataatttctctctgaaagcttattgacccaggaaataagatctctttcaatctgagtgcgtcaggctttattcttgtcattttgtcttttgataattttcaaatggaattcatggaatgttggcttatattcatatattagtaaagtatgttgagacatcttaagattgatttgtggttctatatgccatattaaatcaaaataatagctgttaatggttttcacattagtctgtctcttgtttttatggagtaatgctgagagttcattatgcttgttctacagaagagcatgttaaaaggagtttttggagtcagagaggttattcttggtttcataggatacactctatactttttagggatttcagagtatatagctgaaggtgatattttatgtaaatatgttttatggaaacttattgctcatcgctgtttcctgttaactctcctaaaatataattaaacttttggaacttttttatagcttttgtgctagactaatttttgtctctaatgaggttatataaatggcagcttctgacgttttcaatgtaggaagtcatttaaaacttcatgtatattgtgaaaatgtagtctgctttaagctctctaaagtggtctaagttactggttcctaagtatggatgagcatcaaaatcatctggaaaatttgttaaaaatacagtaatgaaggcacctcactgtcctttttcccaaacatacttctgcattctgtttgagtaggtagggactacacatttttcacaagtatcctcttgggaatacccaggaatgcttacttgagcaacctcttactaatatgtaccttgataaggtggctaggtaaacataaatatacaaaaatccatagatctcccatatattagcataaatcagctagaaaatataacgtttaaagatctagttcacagtagcaccaatatatcgaactctaaggaatcgataaatatgcaaaaactttataaaaacttctgttaatgtttctgaaagatataggtgaccactttctagataggaagattttatattactaagttgaattttctctaaattaacacagaaatttaaaataatcttgatcaaaattctagtagaggtatttttgaacttgttcactgcaagaataaatacataattgcaaagaatatctcaaaatcatcaccaggcctggtgtggtggcccatgcctgtaatcccagcactttgggaggctgaggcaggcagatcacctgaggtcaagagtttgagaccagctggaccagtgcggtgaaacactgcctctactaaaaatacaaaaattagctgggtgtggtggtgcatgcctgtagtcccagctacttgggaggctgaggcaggagaattgcttgaacccaggaggtacaggttgcggtgagcctagatcgcaccactgcattccagcctgggcgacaagagcaaaattctgtctcaagaaaaaagagaaaaaagaaaaagaaatcaacactaatatggtgagacttaatgtatgtgacattaaaatagtgattggatgttaaaacaggtatagaacagaaagaagagtgtatgtgtgtatctgtatgaatttatgatgggtgtaacatatatgtattagggaaatgagggaaatgatacatttctctgactttgggagaacattatatctctacctcatattgcaaacaaacataaagttcagattaattacctaaatgtgaaaaaatgaaataatttctttaaaaaatgtaatcttagtttgaggaaggttaacattataaaggaaaaaactgttttgagtggaatatagttcaatatgtcaaaatccaccttcaacaaaattgaaagtaaattgaacttggggaaagtattgacagcatatagatcaaaggttactagcctgtgtaaagagcagttataaatatcgttaagaaaaacactgtcgacctgtcggcaccttgttctccgactcccagcctccagaactgtgacgagtaagtgcttattgtttaaaccacccagtctgtatgtggtattttgttatagaaactcaagctgattaggacactagtaatcagtagactgaaactgaaacaaaaataagaaccttttttacctgtcaaattggcaaacattaagaatattcagatttttgtcagaggtgatacaaccttctaagaaggcaatttgggaaaatataaagctttagattattatatgtctgacctagcagttttacctctagggtgcttacccctaggaaagtgtgtaatgatattggtgcagtgcccttcatcccattagaaaattaaaaataaccttaatggcctaccactaaaaggggattgaaaatttaagatatatttatttatgtgtttattgagatggagtcttgcactgtccgcctgggccagagtgcaatggtgcgatctcggctcactgcaacctctgcttcccgggttcatgtgattctcctgcctcagcctcctgagtagctgggattacaggctcacaccaccgcacccggctaattttttgtatttttagtagagatggggtttcactgtgttggccagactggtctcgaactcctgacctcatgatccgcgcccctcggcctcccagtgttgggattacaggtgtgagccactgcgcctggccagatacatttatacaagagaatgttagttaacattcatagatatttatattttgtttactttttattaaaaaaattttttttagagacaggatcttactctgtcacccaggcaggatgcagttgcacaatcatagcccactgcagcctgaactcctgggcttaagtgatccttctgcctcagccttttgagtacctgggggactttaggcagtgctactatacctggctaatttttaaatgttttatagatgagatcttgctgtattgcccaggctggtctagaattcctgggcccaagtgatcctcccaccttggcctcccaaagcgctgagattacaggcatgagccaccacttctgaccaatagatatttatatttgtgactggaaaatatattaacaatgtgttaaaaaattcagttaaaaaataatgaaagatttttgcttctggctaagatagaataacaaggacagcatttatcttcttgccttgaaatagttgaaaacggaagaaatatatgtaacagtggttttcaagttattgggcatcaggcaaagaagaatagttatcccaggaaaatgaatgtggagagccctacaatttccttacattactgcctggtcatggcaagaggaaaaactgagaggagactgaggctgagccagtggtttgctgggttgaggaggcagagctgggagtgcagagatgcaaggtggtgagagcccatatggaagaataccagggaagagagctgcagagggagctccggagacctgcaccctgccctctcagtaccctgtcatgtgtgtagctgagtactgacgagcacttgcttgtgcggaaatgacccagggctggaggtagagccacctgaaaggattagaaggaacagttgctgaaagtcacacagggccaggaagaatttctaatcacaccagttggagtggaaaacctcagctctcatagagcaggtagggtactcagaagggtttgcccacctagccccagactaagtttcgttactctgaccctacctaatattaaaaagagattaattaaattgttcgcaacaaaaataatatatttcagtgtttgtaacacgtagaagtgaattgtatgacaatagcataaaggctggaagagcagaaattgacatgtatttgcgctgggcagaataatgctcccctctttccccaaaagatatcaagtcctaatccctggagcctgtaaatattactttatatggaaaattgttttatgatgtgattaaattcaggatcttgagatgagggggctatcttggatgatctgggtaggcactaaatgcaatcacatatatataaaaaggaggcagagggagattttacacacagagagaaggccctgtgaagatggaacagaaagatttgaaggtgctggccttgaaaattggagtgatgaagctataagccaaggaatgcagcagccaccaaagctggaagaggcacggagcagttctcatttagagcctactccagagggaatgtggtgctgccaattccttttttttttttttttttaagatatcatttacccctttaagttggttttttttttttttttttttttttagtatttattgatcattcttgggtgtttcttggagagggggatttggcagggtcataggacaatagtggagggaaggtcagcagataaacatgtaaacaaaggtctctggttttcctaggcagagggccctgccacgttctgcagtgtttgtgtccctgggtacttgagattagggagtggtgatgactcttaacgagtatgctgccttcaagcatctgtttaacaaagcacatcttgcaccgcccttaatccatttaacccttagtggacacagcacatgtttcagagagcacggggttgggggtaaggttatagattaacagcatcccaaggcagaagaatttttcttagtacagaacaaaatggagtgtcctatgtctacttctttctacgcagacacagtaacaatctgatctctctttcttttcccacatttcctccttttctattcgacaaaactgccaccgtcatcatggactgttctcaatgagctattgggtacacctcccagatggggtggcggccgggcagaggggctcctcacttcccagatggggcggccgggcagaggcgccccccaacctcccagacggggcggcggctgggcgggggctgccccccacctcccggacggggcgggtggccgggcgggggctgcccaccacctcccggacggggcggctggccgggcgggggctgccccccacctcccggacggggcgggtggccgggcgggggctgccccccacctcccggacggggcggctggccgggcgggggctgccccccacctcccggacggagcggctgccgggcggaggggctcctcacttcccggacggggcggctgctgggcggaggggctcctcacttctcagacggggcggctggtcagagacgctcctcacctcccagacggggtggcagtggggcagagacattcttaagttcccagacggagtcacggccgggcagaggtgctcttcacatctcagacggggcggcggggcagaggtgctccccacttcccagacgatgggcggccgggcagagatgctcctcacttcctagatgggatgacagccgggaagaggcgctcctcacttcccagactgggcagccaggcagaggggctcctcacatcccagacgatgggcggccaggcagaaacgctcctcacttcctagacggggtggcggctgggcagaggccgcaatcttggcactttgggaggccaaggcaggcggctgggaggtgaaggttgtagtgacccgagatcacgccactgcactccagcctgggcaacactgagcactgagtgagcgagactccgtctgcaatcccggcacctcgggaggccgaggctggcagatcacttgcagtcaggagctggagaccagcccggccaacacggcgaaaccccgtctccaccaaaaaacacgaaaaccagtcagacatggcggtgcgtgcctgcaatcccaggcacttggcaggctgaggcaggagaatcaggtagggaggttgcagtgagtagagatggtggcagtacagtccagccttggctcggcatcagagggagactgtgcgagggcgagggcgagggcgagggaattccttaatttcagtttagtgatactaattttggactctggcctctaaaactgtgaaagaaaaaattttttgtttgtttgtttcttttaagccacatagtttgtggtaatttgttacagcagctgcaggaaactaatttatgctgcatgtgaaatggtgtaataaggtagattgtgatgaagatacatagtataaacaattaagcaacaactaaaagcacaacaaggaattatagctaatgaaccaaaaaaggagattagaataataaaaatggtgaatcccaaagaagccagaaataggggaagaggcaaataaaggaaagaaagagcttgatggtagatttcaacctaactatgtcaaaaaggacattacatgtaaaaggcagcgatttttcagattgaatggaaaagtaagactcggtatatgctgctgcctgcaagaaacacattctaaatataaaggcaaaaataacctacaggtaacagaacggaaagaagttcactgtgcttacaagaattagatgcaagctagactggttctgttaatatcagacaaagtggatttcaaagcaaaggctcttgcccaggatgagatggtcatttcataatgatgaaggggattcgttcatcagcctggcatagcaagctgaaatgtttatgcaccggactacagagctaaaatacatgaagcaaagcctgacagaactacaagtagaaacagacaaatccacagtgatagagatttcagtagccgctctcaatgatttgtagaacacgtagccataatatctggatctagaacacttgaccaacactgtcccctgtgcaacctcattggcatttacaggacactccacccagcaccagcagaagagacactctctcaagtgctcacagaatgtttgccaagatagagcagatgctgggccataaaacaagtctctaaattaaaagcattcaaattattcagagtatgttttctgacctcagtatcattaagttggaatatattataggaagataacctggaaaagcctcagatatgtggaaaaacccatttccacatggcccatgggtcagaagtgaagtcaaaagggaaatttgaaagtcttttggattgactgatataaaaacaatagatttctaaacttgtggggtgctgttacagcatagtaaatggaaatttctagcattaaatgcctgttttaggaaagaaagatttcaaatcaatgacctcagcttctacctttggaaacttgaaaatgacaagcaaatggaatccagagttaccagaagggccaggtacggtggcttatgcctgcagttctgccactttgggaggccgaggcaggtggattgtttgagactggcagttgaagaccagcctgggcagcctagggagaccccatatctacaaaaaacaaaaaaattagccaggtgtggtggcatgtgcctgtagtcccagctaaccaggagtctaaggtgggaggattgcttgagtctgggaggttgaggctgcagtgaactgtgattgtgccactgtgttccatcctgggcaacagaatgagaccctgtctcaaaaacaaaaacagttactagaagaatggacatcataaagataggagcagaagtcagtaaaatagaaaacaaaaatacataggaaatcaataaaaccaaaagctggttcatcaagaacatcaataaattggtaaagctgataggaaaaacagtgaagtcacaaattagcaatatcaggaatgagggagatgacagtagtatagattatatagatattaaaaggactgtatgaggcaggtgtggtggttcacgcctgtaatcccagcaccttgggaggccgaggtggacagatcacctgaggtcaggagtttgggaccagcctggccaacatggtgaaactctgtctctactaaaaatacaaaaattagttggtcgtggtgctgtgtgcctgtaatcccagctacttgggaggctgaggcaggagaattgcttgaacctgggaggcggaggttgcagtgagctgagattgtgccgttgcactccagcctgggtgacagagcaagactccatctcaaaacaaataaataaataaaaaggactatatggtaatattatgaacaactttatgccaataaatttgacaacttatagatgaaatggatgagttccttgaaagacacagaaactattaaagctctctcaagaagatatagataagctgattagccctatatctattttattgaatttaaatgtaaaaatcaatatttagttactggaaaacttttaagtgtggttggaaatggtatacgaactttttcaactgaattttatgaagtctaatcacaggtaaaggttttctgatgaaaatttagtgtctgaattgagatatactgtaaaaaatgttatatatcttaattatttcttcacattaattacatgttgaaataatactttgggtgtattgggttaaattaaatattatgaaaatcttgcctgttttctttttacttttgatgcgtcagctaggaaatataaaagtgtagctcacattctgtttctgttgacagtactgctttggagcacagtgtttgaatgatctatcatttcaaagacctttcctcagttcgttattcatggctgtctgtattccacatagataaggtctgaaatactgctaagtggcatgttttgttttatgcttttataagtttgttgatcattactgatgtggacttttggtgcctcttaggctcattgctatcttccaaccattgtttgcaatttttacctagagataaagagaaagagacatttggtttcagagtagttagattgggatcatgaaagagcaacctcattttgatgcttcaaaaatagcacatcccccgtattactgggatttgctattcttgggattacttcaagaacatccttgtgttactggtttggatgcttctgaatgctgtgaagtcagtttcatgtacatggctcatcagtttagctctctcttggctttgtttagacagttggagcatgatggcctaaacagcttctttcaattaaacattttaaaatagtttacaaatagtaaacaaactccagtttttgtgactctttgtctcgcacaacaaaaacacaatctgaccatgatcatctggcatcttagggtgaaatatggttatactttggcccataccgaaagcaagattaaaaaggggcaggagagatagactgctgaactgattttcaaggttccaagaatattgtaggttaagagtaaaagtaaacttttggtagaaagcagtgggttgtctaggattgaagtatctgaagtttttaaacgaaaatttaaaaagaaaaatgagaattgccttacaagtacaatctcttcttttttaaaaaataaactttattttgaaatagttttagatttatagaaaaaaattagatagggtaggaagttttcatataccctacatccagttaccccagttattatcatcctaatttagtgtgagacattttcatgtttaatgaatcaatattgatatgctattaacttaagtccagactttattcagattttcttaatttctatgtaatgtcctttttctgttccagaattccatgcaggacaccggatacctcattacatttcattgtcatgtcaccttaggctcctcttgacagtttctcttctttttttgcttagaaattctccagaatttcagaaacttctgggcatcgctatggaactttttctgctgtgcagtgatgacgcagagtcagatgtcaggatggtggctgacgaatgcctcaacaaagttatcaaagtaagaaccgtgtggatgatgttctcctcagagctatcattgttgtaggctgagagaagaagcgatcattgagtgttcttctgttttgagtccctgaggatgtctgcacttttttcctttctgatgtatggtttggaggtgctctgttgtatggtttggaggtgctctgttgtatggtttggaggtgctctattgtatggtttggaggtgctctgttgtatggtttggaggtgctcttgtatggtttggaggtgctcttgtatggtttggaggtgctctgttgtatggtttggaggtggtcttgtatggtttgcaggtgctctattgcatggtttgcaggtgctctattgtatggtttggaagtgctcttgtatggtttggaggtgctcttgtatggtttggagatgctctattgtatggtttgcaggtgctctattgtatggtttggaagtgctcttgtatggtttggaggtgctcttgtatggtttggaggtgctctgttgtatggtttggaggtgctctgttgtatggtttggaggtgctcttgtatggtttggaggtgctctattgtatggtttggagatgctctggtatctgcctgcattgcttgccacacctgcccggtcagaaggcgctatgttgacaattgtgcctgcacggtgcctaggtcaatgaagggaaccgatggtagccactggatgctcctgggaaaatgtcactacaggcaccagagaagccagagctatgcccaaatttctatgagtctcagttttcttaaccataaaatgggatcaatgtttttgtggcatgtgtatgagtgtgtgtctgtgtatgtgtgaggattaaattgtgtatgtgtgaggactaattgccactactggatcctcaaagtggtaagaagtgttcttattaataatgacatccttacactcttacccagcaagattgatgggtgtggcactgcttctctttttccatcacatggtttccatggtatccttttgcccagggaatctttgctttgtggctagcactttgttgtttggctaatcacgctttctgtggtcaggacgctggcttctctggagccatgggattctagctccctgtcttgtccctagagtggtcactgtcttctctctccgcttgcaattcctgctttgctcgcatctcacttatgcagtgacgtatatcagtttcaccttgttctccgtgcctgctgatcattggcaccacttgcatggtgccatttagggcctgcttccagttaagcttgcttctccacaggcctaaatatccttgcttgcttcttttattctcactggcaggaccagggcggtctgtctttgcatgagacagggtctcgctcagtcacccaggctggagtgcagtggctgatcacggctcattgcagccttgagctaccgggctcaagctatcctcctggcttggccccttgagtagctgggactacaggcgtgcaccaccatgcccagctaatttttaaaattatttgtagagatgggatctcgccaggttgcccaggctggtcttgaacgcctgggctcaagtgatcctccctccttggtttcccaaagtgctgggatcacaggtgtgagccactgtgcctggcccttgatgtttcagttcttgatatttgatcctcagagtcagaaaatctaaaaagagggctatcccaggttgccttggttcatggcaaatgggacgttaagagggcagagagaatatgaacagaaactgttctaatattggtcatttaatgtgtaagtattgttcttttttaaacctccttcattttttttccaggaattgctggacacagtggcttggtgtgtgtctgaggactgtaggccatggccctaggttgtggttttaggtctcaggtgctcttcctggctgtctccttgcttctttcccatgtcctcttctttgtttccagccatttctcccttatgcttaagtttggtgcagcagggtttggctgctctcagattcctgcttcctcagatgctgtagttgtcaggcccagcgggctggcagcgggatcaggatctggctaggtttgctctcactgtggcagagtagggggaggcgtgggagagcacgtgtgaccccaggccagctgtagggagcataggcatggtcacgtagccttcaggtcctagactttgtcttctcatgagtatggctgtgtgtgtatggtgaaaactaggttctacttagcccaagaaaatgggcacattttgcatgtggtttctgtagagaaatgcactgggtatctgacatagcctggcagcatgcctccctcaggtaggttagtctcaggcggtgaagcacgtgtgtccagcaagaacttcatatgtggcataaagtctccgttctgtgaggtgctggcaaatcaccaccaccgtcaagaggctgaagtgatttttgtctagggaggcaggaaaggcttcctggagtcagcagccagtaggtgaaagagtagattggagaccttcttaatcatcaccgcctcttgtctcaaggggtgccaggaagctgtggaggctgaacccatcttatgctgccagagagtgggacaccatgagggtcaggtcaaggggttgtaccttgtttggtagagaattaggggctcttgaagactttggatgtggtcaggggagtgtatcatttaggaagagtgacccggtgaggacgtggggtagaggaggacaggtgggagggagtccaggtgggagtgagtagacccagcaggagtgcagggcctcgagccaggatggtggcagggctgtgaggagaggcagccacctgtgtgtctgcggaagcaggggcaagagggaagaggccagcagcgtgctgccatcacccagcgactggcgtagattgtgagagaccattccctgctcttaggaggggctgagttttagttttctcttgttatacaataagcttggtatttgtttacaaaacatttgtaaagctaaatcaaggtttgataaggcttctagttttatttaagaagtaatgttgaaataaatgtttgtccaattcgctttgctcatttaaggactttcagtacaaactgcaacaacaggattaggatttaaacgtttctgagatgtttttactcctcagaatttcccagaatgtgatctggttttgattttcaagcttgctgacccaataggttaacccacaagttttacgaagaccatctcagtccacttacatcaactgcccatgccacggttaaagagatcatcgactgatgtttggcacagcttcctccctcttgggtgggcaagcatttggaagagaaggctcctatgggtgagagtggggcaccaaagtcttccctgtcccatcccctagcttgagaagcccttctctaatgtggactttgtgccgttagcatcgttactagcttgaagttgaccatctggacgtactttctggtttagcctcacaagtgagcaaggagggttgagagatgtgctgtgaggaatgtggggccccagctggcagcaggctctgggtcaggggggcagggaccacgggcatacctgacagtgaggaggggccacacctgcagaaaaggatgcaggactccgccttgggaagtgttctaggccagagcgagggtctgtggtttataagtacacccacagtgctcgggaccctgcagatgtccagggtgccgtctgagcccgtatcatccaacagaatgttctgctagtgaagattaaagatttactccaggggctttaggatttattatatatatataaatcctatatatataattttttttttttttttttttgagatggagtttcgctcttgttgcccaggctggagtgcaatggcgtgatcttggctcactgcaacctccgcctcccgggttcaaactattctcctgcctcagcctctcgagtagctgggattacaggcgcccaccaccacacccggctaatttttgtattttttagtagagacggagtttctccatgttggtcaggctggtcttgaactcctgacctcaggtgatctgcccgccttggcctcccaaagtgctgggattacaggcatgagccaccccacctggccaggatttattgtatttgaaccatctaccattttaattttgatgttatgtagtatttgatgataatgaaagttaaattgtttttctttccatttttctgtttaagtgaatgacctgtatctagtttattcagtaacttcctgcatatatttgtttctttcattcttaatgaatatattcttaatttagttgctattatgttttgctttgccccaaaattgaaatcttagtttccttttagctcgttttagaactagtgatgggatgtgtcttccataaatctcttgtgatttgttgtaggctttgatggattctaatcttccaaggttacagctcgagctctataaggaaattaaaaaggtgggccttgcttttcttttttaaaaatgttttaaattttaaatttttataggtacacgtattttgtaggtacatgtaaatgtatatatttatggggtacatgagatattttgatacaggtatacaatacataataatcacaccatggaaagttggatatccatgccctcaagcatttatcctttgtgttacaaacaatccagttacatgctttacttattttattttatttttgagacagagtcttgctttcacccatgctagagtacagtggcatgaccttggctcactgcaacctccgcctcccgggttcaaccgaactttgggctggtctcgaactcctgacctcaggtgatccgcccgcctcggcctcccaaagtgttgggattacaggcgtgagccactgtgccgggcctgattgtacattttaaaataactaaaacagtcagggcacagtggctcatgcctgtaatcccagcattttgggaggctgaggcaggtgatcacctgagatcaggagttcgagaccagcctggccaacatggagaaaccctgtctctactaaaaatacaaaaattagccaagtgtggtggcgggcgcctgtaatcctggctactcgggaggctgaggtaggggaatcgcttgaacctgggggtggaggttgcagtgagccgagatcacgccactgcattccagcctgagcgacagagtgagactttgtctcaaaaaataaaaatgaaataaaattgggccgggtgtggtggctcacaccttagtcccagcactttgggaacctgaggcaggtggatgcttgagaccaggagtttgagaccagcatgggcaacatggcaaaacgctgtctgtacagaaattagctgggtgtggtggtgcacaactatagtctcagctacttgggagattgaggtgggaggattaattgagcctggaaggttgaatctataggtagctgagattgtgccactgcccttcagcctgggcgaccaagtgagaccctgtctcaaaagaaaaacaaaaaaacaaaaaacaaaccactattatcgactatatattattgtctatgatccctctgctgtgctgtcgaataccaggtcttgggcccttatttccatcactgagcaaacttcactctgttaagcagcaggtgtgggatttcatcgttattcagtaattcacaatgttagaaggaaatgctgtttggtagacgattgctttacttttcttcaaaaggttactctttattagatgagatgagaattaaaaatggtaacttactttatatctttataattgaagcccactagaccttaaagtagttaccagatgttttatgcatttaaatggccttttctctaaaattagaaagtaacaaggaaagaaaatgcttcgtttctatgcaaccctcttggtgactagtatgtgactcttaatgcaaccctcattgcaccccctcagaatggtgcccctcggagtttgcgtgctgccctgtggaggtttgctgagctggctcacctggttcggcctcagaaatgcaggtaagttgtacactctggatgttggtttttgtcgggggccagctgctactgatcctttatgtctcagctcagatgtcatttcaaaagtctgctctgccctctccaaattgcagtcgaccttgccctgtttatgtttccctcatagcactaatccatgtcagaaattgtcacgtacagtctatctgtgtgcttgtttattttctatcccacccttccgcaagagacttatgggatgtgtgccccaggacagcaggggtcttactgtcttatgctctgttgcagcccagcagcgataacagtgtctgcacatagtacttgcttaaaagatacttgccaaattgttgaaggttgaggtaccaatttcattattgctgactataggagttatagcaaaatatccatttgtctgttacatgagttaaaaatatggttgttgcactgtgaatagtttggtttagtcaaaacagttgtatcttaacggattgagaaacaaaagcaggaccacttttcatcagctccctccttctccttaaccagcaatacatgctgatgctgatatcccatagaccctcagctccatcctgagtcactgggaatgtggtctaaaccctcactattaatatgaactgagtttcaataagaatcttatatgggtcgggcatagtggctcatacctttgatcccagcacttcaggaggccaaggcaggtggattgcttgacccagactaggcaacatggtgaaacgccgcctctacaaaaaatacaaaacttagccaggcatggtggtgcgtgcctgtggtcacagccactcgagaggctgaggtgggaggatcacttgagcctgggaggtggaggtcgtgttgagccaagatcgcaccactgcactccagcctgggcaacagagtgagacctgtctcaaaaaaaccaaaatccagaaaagaacttatatggctgcagaggtataatcactaaggaaatttccttttgtataatcttttttcttttactatcatttaaaaaaatgtgttatatttctgaagcaacacatccaggttctgcacatagcagccaaagtgaccttaaagaatataactgggtcttgtcattcccttatttaaactcttgtacccatttcccagtgccgtttagatagagattccagactcgtcaatggctctgtcacctcagacaccctgcattgactcattagtctgattagagtcaggtttttcttcctcctgatggtttttttttcccccttagttctcagcggaacagtcacttccttagggaggtttccccagccaccctctgaggccgtgcttgttgccagactctgccactagagggcagggctgcaccactcctggcacctcgcacccggcctgccctgtcactctgtgtgttgggtgaattcctgtgatctgtgactcactgctctgtgtcctacacattcggcttttcttctctccccacaaccccattttataattctcctttttcaggaaagctttattcccatttaaaaatttttgtttttaaaatggtattttcttacacttattttctaattaaaaatgagtgttttaagaagtattatgatttactgcaaataatttttaaacccagccttttagatcctctgtgatcataagagaaatgaaggatgtctcccaacacttgagcttcatccacatttcatcctcctgttctttcagctgagttttccccatcccattagggactgttggaatataaaactggcttttccctaacagggaatgaattgcttctgtttctcctgaaggagagctggaagaatgacttgcgttcttttgcatacacaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggtatgattgttgcctcaggtcacaaacatgcgagtgatgctgtgagtgagtctgtggagggtgagggcttctgaacagggagtcctgtgggagtgcttcttggggtatgttgtatgtcgtaatttagactaccatcatttgtgttatttttgaggcacctaaggacttctttccacttctcatttcttactgtggggtgaagagttgaattgggagatggtttctagatgcaaattgaaaaggcatttttccagagcagatttgttttcggcgtactagagtgactctttaacctagctgcgggaagatgactgtgccaagactgcaggtaggagaaagctcactgacgaggccttgtgggtctgaacgtcctgcagctatcagagcctgttggcttcctgttgtgcattccaacaaatcatcttcaaacccactttagtgttttgtttataatgtccagaaatagtgaccctgtcacatgctctacagattacaggattcttagcctcttcctttttggtaggtcagtcctgggtttgagcccaagtgaccctcctgggaggtgatgatacacactgggtagagtggaatcagatggacttggattagaattctgtcctctttactagttattttcctctaggcaaactgcccaacagctctaagctatttccttcgtattctgaaaaataagccttaatgggacccatatagggcaactctgagagtaaaataaaggaatatgtgttagagtgtagcatagtcacccacgggaagggcttagatgttagctgctactgctcttattagctgaatgatttggaataaactgttagcctctctcatgttttttctcttgagcttcgaagttttcttgttaatactaaggagatattcaaactagtcatggggttttggaatgacgaagggagatgatgaatctaaagaatttagtgtaatatttcttcatgctcagtaaatggtagtttctgctgctgttatttttattaccatctctttggaatgggagtaggtgctcctttgtggtcagaggctgtgagagctccacagcgccagtttgcccatctgtacactggggtctgttgaaggcagtcccctctgtgatatctctggctgtcagagctcagatgatagatggtatttttgtactcttagttctcatcattttcatgatttcgatcaccatttgagtatgatgatgctaacactttgttgaacgtagaatccgttaattacttccttcctgaacctttggcattaaaaaaaatctattctgctacctctctgctcatttatggttattcaaatttattatcaagagcctggtacagtggcttgtgcctataattgtagctacttgggaggctgaggtaggaggattgcttgaggccaggagtttgagaccagcctgggcaagatagtgagaccctatctctaaaaaaactgaaaaaaaattagctggacatgatggcatgtgcctgtggtcctagctactcaggaggctgagacaggaggctcggttgagcccaggagttggagttcgaggctacactgagctgtgattgtgccaccacactccagcatgggtggtaaaacaagatgccatttcttaaaaaaaaaaaatatatatatatatattatcaatgaaattcagtagtaccaacaggattataaacaaagatagtagttcccttcctactttttctcttaatccttgtgtctcacaggcaaacataactcttagtatttcttccaatatttactttcatgtttctttctttctttctttttttttctttgagatggagttttgctcttgttgccaaggctggagtgcaatgacgcaatcttggctcaccacaacctctgtctcccgggttcaagcgattctcctgcctcagcctcctagtagctgggattacaggcatgcatcaccacgctcggctaattttgtacttttagtagagatggggtttctccgggttggtcaggctggtctcgaactcctgacctcaggtgatcctcccacctcagcctcccaaagtgctgggattacaggcgtgagccactgcgcccagcaacttccacatttctaaataacatgcttctactgctattttttttttcaattttagacatttttttactttcactatagttctatcagaattcagtgtgtacgttattatgcctaagtaaatagtcatggttgcttacgtattatatttctttgattgtgtttcttatttgatgagaaagctgtgttttttgctctgggttgaaactggagagaggacctggggaggaggaggaggacagatgaagttggtgactgtaccttcatggccatagctgggttctcagcacccggggatctgctgatcacctactcataggccaggcccctatcgaagttctaggtgacccagtgctggggacgggggggccacctgcaaggtctaatcatggaggtgggggctacagtgttggcttgtgctggggccagcatccttaggaaggcatcttggaggtggaggagacagccgcccacttcttgattggggccttcagcagcaccagcttcttgggcaggctggtgctggctttcatcaccatgtcgtgttcaatcttcttccagatcctgacttctaggttcagctttcctcagaccctggttcctttcagaggccattgctgctgccttgctctttgctggcttgtgccttgattatatgtctttgtacaactttttgttttcctggagttaatcttcacatctgttttcttggagttaatcgttacctctatatcgcttgcttattattctttggcctttttgtcttctcacaccttccaacttctttgtaatatgtgtttagtacaatttttcatgacaggtagtttactgaatcagtttttccccagtgtggtcatccaacttgagttatccagctctctgccccagtctgggcaggttgatcttcaggtctgtagtacacttgtatcctaggacttctctttgccattagcctggaatttcctttgcagttctcccgttggatgcccagttcctagatgccatatgtttttctatcgtctagtagcttcctgagagaagatgaatgggagggaaattgtatgaggttttgcattcataaaaatgccattttttttcctgtacacttggctgggtatggtgttctggggtagaaatcattttccctcagaaatgcaaagtctttgccctgttgtcttaaaatctccaacgtgacccgattccttaacctatgaatgtacttttctttggaagctttccatttttggggaggtgaagtgctaggtacttagtaggccttttaatttggaaacttacatcccttcagttctgggaaaattttcttaacatttctctgagaagttcttgccttttattttctgtgttctctcctgaaattggttagttggatgttggtcctcctagattgactcacatcttacctttttcttttctttttctggtactttttagatatccatctcaaactcttctattcattgttatgtttttaacttctttcttttctttgtctcttgatggggtcttgccctgttgcccaggttgtggtgcagtggtgcgatcatagctcactgcagcctcaaattcctgggctcaagcagctgttctgcctcaccctcccaagtagttgggactacaggtatgcaccaccacgtccagctattttctttacttttttttttttttttttgagatggagtcctactctgtcgcccaggctagagtgcggtggtgggattttggctcacttaagcctctgcctcccaggttcaagcagttctcctgcctcagcctctcaagtagctgggattacaggtgtgcaccaccatgcccggctaatttttgtatttttagtagagccagagtttcaccatgttggccaggctggtctcgaacgcctgacctcaggtgatccgcctgccttggcctccgaaagtgccgggattacaggcgtgagcccatcattagatctttaaataccagtatctataagtcttttcctcttgagtcagctagtatccctggaaggaaattactcattttcctgcttggaggctataagcttggctatgtttatcctgcaaccggggactggaagggaggggactgacagtgttgctggtcagggtgccctcttactttttgttttctgtgtgcatctcacgtctgtcctcagcctatgtaaacacctcttgagattatccctctcaatctttgccggaggtgggggaggggctgcttcctgggctgccttggattggagggaagacctcaggtgagtgggtgggaatttgcccaaggagccatgagaccagccactatttcaccctctccatccctccactttcagatgtatgtggcgcctccaaagcccgagctcttcttggcgtctgtggcttcaataagcttgctttttgctggtatccctcctaccctcccctgtccccagcaaagcttgcatttgaacttcttcctacgggctaacaaatcagtcagttatgtagctcttgttactttttagcttccgaagttttgttgacacccgtagtctgctaatgtccctgttctgttctttctgttcgtgtaaatatatgctttatacaacttctttacatgatttttgtggggtttctgggtagcagagcttcacaagttcaatccagcgtgttggattagaaatctcccaccctctggtttattcttattctcaaaattacctgccaaacactgatactcccttgtttttccttttcctgacaggaaatgtacataccatacaggacagaaatcattagtgtatcccttggtgaataaccacaaagtgaacttaacccttgtaaccgccacccaggtcaagacagaatattaccaagcactcagaagcctctcccctattcccccgtcactgctcctgccttcctccccaaggtcatgactgctggcttctaattccagagtctgtttttaaattctgtgtacatagaccatggattaagtgttctttttgtctggtttattttggtcgacattaagttcatgagagtcttctatattatcgtgtgtattagtattcctgtagttttaggagcttcatagcattccattgtagggatataccacagtttattcattgtattatcactgggttgtttctagttcttggctattgcgagcagtgctactgtgaccactcttaggtgtgtcttttggagtacatgtgcaggtttccatcttgcacagctagaggtggagttgttgggtgatagggtgtgtgcatctcagctgcagtagaaactgccaaatagctttccttgagtgcttgtaccagctcacccttttgccactgtgtatggggattccaggagctctggtcctcgctagcacttggaattgctgatgcttttactcttagccttcctgatgggtgttttctggaatcacattatgattttaatttccattccttaaagtacccttggctctgaagtttaatgattcatgcatctcttcccttttgaagtactcttacaggtatgttgtgcatgtgttgaaaagtggcactatctattctaaaatacagtatgcctcctctgtgtttgaacagttgtagcgtggccttggggcctcctgttagctggcttggagaagggattcttgggattgtagagattagacctgaggaggccccttggagctctctgactaaattttattctttattattccaaactatttaagctcaccgtgtgctgactcatcataataatgagtagctctcattgtgcttgtctatttggactcatacaatgattttttttttttctttgagacagagtcttgctctgttgcctaggctggagtgcagtggcacaatctcggctcactgcagcctccacctcccaggttcaagtgattcttgtgcctcagcttctcaagtagctgagactgcaggtgcgtaccaccatgcctggctaatgtttgtatttttagtagagacggggtttcaccatgttggccaggttggtctcaaactcctgacctcaagtgatctgccttcttcagcctcccaaagtgctgggattacaggtgtgagccactgagcttggccaaagtagttttttaagatgttagtatcttttcttgcagctaaaaaagtttgtcagagatgattctactttgttctccaggtgttttctcagggagaaattggaggcagtaagccactgggggagtcctgtggctggggggtggggtagtcctgtggctccttgtcagggagtcctgtggctggcaaggagagaagtcctgtggctgggttgggagggagtcctgtggctggggtctcatcctgtgcctaacagtgtccagaggtgccgagaccagctcagtcggggagaccctaacccagcagcgctagaggaattaaagacacacacacagaaatatagaggtgtgaagtgggaaatcaggggtctcacagcctttagagctgagagccctgaacagagatttacccacatatttattaatagcaaaccagtcattagcattgtttctatagatgttaaattaactaaaagtatcccttatgggaaacgaggggatgggccgaattaaaagaagaggttgggctagttaaccgcagcaggagcatgtccttaaggcacagatcgctcatgctattgtttgtggcttaagaatgcctttaagcggttttccaccctgggtgggccaggtgttccttgccctcattcctgtcaacccacaaccttccagtgtgggcattagggccattatgaacatgttacagtgcttcagagattttgtttatggccagttttggggccagtttatggccagattttggggggcctgctcccaatacagaggtctcgtgtaaattccctgggaggcgataagcctctgagaaacagactatgctaaccacgccatgaaagagaaacttatttataaatcagatgccagttactagtttactgcttatttgcccaggcgtagctctgacagagtccccgactcatagtgcttgctcagtgcatgctgaacaatgattggaatcaagtcatggctcagagcatagttttgaataatgggaaatggatgttcttaagtaacatagtcaccaagataatgcgactagctgggtcaccccttttcaattttaggatatttttatcaagatttaaatggccatcattagagttatagcactttctcctttggattgtcctagaggcccatgagaaagtattccctaatttcttaggagaacagtttgtgggtagtatgcggtcatgtccagttaaattgcagatatttccgatcgaagatgttccagtcctgagaacttcgtgacattagcaggacttctacaagccatctcttagggtggggcatttactgcagttggctagtactcttttctccttaactttgtcatttgttgatttttttttaactgtccccaaatactgtgggcagagtgtatctagaattgaggcctccaccattgcggagaggacatggatgctgagcagtcccctgagtgaaggttataaagaagcaaatagactacacatgtctgtaaactgctcttgagtgtcccaaatttggggtacttcagttcagctgtaggaaaagcctcaaactgtttatactttgcaagaattggaaacttctaattcacgttaagttttatgtaatacatgataagcttcataggagcttcatcttttatctacttggacttttgcttccgtaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggtaaggtggaggcatatgagtggaagagtctccagcatgtactcaagatagacctttgaaataaataaaaccagatgatccctcagcttctagaccaggctatttggcactggttgattgaatgtgaactgcactggggctgctgtgagcccgcatgggtctctgtgaccctgcagatgcagccgtgcccagggactgggcagtgggtgtgggctggtgtgagccctgtctgccacccagggcctggccctctgtctgtgtcggccatgactatggtgagtcttgtaggcttgagactgtgcctcgggttcctgcgggttctctgtaggtcagttgacagtttctcctgttgtttgggtaactgtggaaacgaacactggcaagtgctgaagcgagcatgtggacgtgcgatatgaaataacgacctggctttcaaaggcagtgaggctctctggaaaggaccttgctgagctagggatgtgggtgtgtagccattcccagtgggcctcatggcgtactcgttcatgatcatgtttgtgccatcttgatctctcaggatctcttcttttttaacagattaagccgggaatctccaaacagtgagtcagatgttaagatgtcttgcttccacccccacaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtaggagcacagggtttactctaggccctgcatgtgaatgactgacattcaaagaaccgattaatttggaagagaagcggcagaaccgagagttagaggtgtggactctggagctgcgctgctcgtttccaaccctaggtgctgacctctagctgtcttccctctgtatgtccctgtcaccgtgagtcaaatgcgggtgatgcctcctcaggtgccgtgttacctaagcctctcagagaccactgctaccctgtttctaaaaccagaggtcacgatatgtgttcatccacccagtaaatactgattgagcacccactgtgtgctaggctctgggataggggctgggtatacaatggtgagtatttcagctgcagcttctgccccgtggaggctgtggcctagcacactggtctaggcacggtggtatatgctcactcaaggagatagggacgtggtcgtttggggtgtcggaacaaaatgtcggaacttctctttccaatgcagagaaaccttgcagtaattctaatgtactgtgattggcagttgacttcagttctttgtagcacgcttactcaggttatttcactaactatgtaaccatgcagcctcattttaagcaattggattttttgaactttacttaaaatgttatgtcagggtttttattgtgcttaatgtgtgccatttagctaagttttgtaggatacgaaattgtaagtggcttaaaatgattcttaatagaatcatgaattgaagataatgctaataatttaagcactgagttaggtagtgtttgtaaaatgcttagaatgcttcctggcacatgttaaggccatgtaagtgctgcgtgttgataaacagctgagcaaaagtggactcttaagaaagtattggggctgagagttctgttccaaccagctgccctttggttatttttcagaataaaagcagagtctcatgggatatgacatttatatttccttcacaaaaaacactgctgagtgttttgttgagtaaaaagggtgtagccatggtaataatacatttaaaatatagtttatttcatctttaccttgccttgttttttttttaagctagctttttattgagaattccacacatacaaaagtatcaactcatgaccagttatatttcatttataatcctacttctccctttttttattatttgaaagcaaaccccaattatcctcttatttcatctataagtatttcagtatctctatagatgaggactcttctttatttttaaaactttatttttaaaatgatggtcagatgcagtgttcatgcctgtaatcccagaactttgggaggccaagctgggcggatcacttgaacctgggagtttgagaccagcccgggaaacatggcgaaaccccatgtcttaaagaaaaaaatcagccaagtgtggtgatgcatgcctgtagtcccagctacttgggaggctgagatgggagggtcacatgagcctggaagatcaaggctgcagtgatccatgattgtaccactgcactccatcctgggtgatggagcaagattctgtctcaaaaaaacaaaactgcaaaacaacgtcacaaaacagtgccattgttagacctgaaaatattaaacatttcctacatcaaatacccaccaactcattatcaatttttctctctactcttttggaatcagcatctaaataaaattggtcgataaggattgtaaatctctttgatgaactggttcccctccatcccagtttttttcccttagagttcatttattgagaaaccagattgtttgtcttctaagttttcctgtggtctgatatactgcttccatctccactgtgtaaattaacacctttttctcttctctgtatttcctgtaaatcaataattggaggaaaagccttgtcagatttagtgtatattttatatctgagtccagtatttcttatataatattttaagataagtgtactcttttaaaaagtattgaaactatatgctcaattttttttaactgatgcttttaagaaggctgcttgatcataaaagtttagagatcattggtctgatgggaaaagcaaataattactaaaccgtttagcaaggttgaggtgcacatggtggggcctggagaagttcagtcatgagccgtcacttatgggcacgtggaatctgacccggcacagagttgggagaagacaggagctttatagacagaaaatgtggtctttgctaagtcccaggagtgaaagggtgagacagtgctcacagcacacgagtgtgggtgcgtagacagagcaagggtgggtcctgaaaaggcctgcaggctttctcatagattagcaagagtgctggttacggaggtttctaacatttgtgaacagatcgaaactgtgttaaattgggattgcagtaatcctggaaggacagggatagagggtgaaggggaaaaaagggtatggatgtgagacttaattgctgattttcttaagacctttctccaaagtaaataaatgatgtggcacatttttgaactggcaaattctaaactctagatatgattatctctataacatatcttactccatcttcttttgactaaaaactgttcttaattaaattaccatgagacgttcaattcagcaaatgtagtttggctaaccatatttaattagaatttaatataatcctaggcctggccaaactattaagcaagtgtgggcaaaatattgataattttagatatgcaggaacttagtttgctttccatgtgtgcttttcgaaaaaggaataaattgaaaaatagaggaagccctgaaatccaagaagcaaactctctcacctaggcatgcagtaaaagcaattctaggatgattgctgtttggcgcgtagttcgtattagaaaccattcttcttgaataaatagtatgtttaagaagctgggcagagggaaggcatatgcatatattatcaacaaggagggagaaaaaggcaattagtaaccatccataggagggtcagcaagatttataaaggaaatttgtgatccaagtatgaagcaaaataaggtgcagaataaattttaagcaagtaatagattagagtaagagaacccatttgaccattaaccttgggacattctctttcaaatgacatggagtagtactgaaatctttctttctttctgagtctaggttattgtgactggactcagaaagaaatatttcattattgcagtgaataacatttgtgaacattattgttcataaattatgcagtgaataacatttatgaacacgtgatgtgtaagatacatactgtttatttttagttaagttttttggctcaacttctaggcagagaacattaaatgtaaatagtgttacctaggagcatgtaaatggaaatctccatagtatgaaagcagtgctgttgctaacagaatttaggagggggcagatgaggtgaaggaaatgtgggtgctgatttccttattacattgagaggagccaggagattctttgttcaaaatggatggcttaagaagtcaaagtataagctgattacgtagagcaggtacccaaaaatgttttgtgtaaggggccagatagtaaatattttcagtcttgcaggccatcccaagtctgtggcagctactcaacactacctttgtagcatgaaagcagccacaggcagcccataaatgtggctctgttccggtgaaactttaggtacaaaagcaggtgcaggccagacctgacctgtgcactgtggtttgctgacctgggattcaggggtatagaagttaccatcagaagagctaaaagtgagactttttactttatactcttctacactgtctgattttgaaaaaaagaaacatgtattttataatattaaagatagggttggcaaatagcaaataaaaatacagaataccagtgaaatttgaacttcagatacattatgagtaattttatggtgtaagtatattccaaatcatgtgggacatacttacactacaaaattatttgttgtttgtttacagtttaaatttgagtgccttgtattttatctggcaactgtaattaaagggaaaaagaataaattcattatgttcatataatgtgatatagcaggggtccccaacccccaggctgcagagtggtactggtccatgggtccccaacccccaggctgcagagcggtattggtccatggcctgttaggaaccaggctgcccagcaggaagtgagcagcaggtgagctggcattcccacctgagcaccgcctcctgtcagatcagtggcagcattagattcccataggagtgcaaaccctattgtgaactgcacatgtgaggggtctaggttgtgcgctccttatgagaatctaatgcctgatgatctgaggtggaacagtctcgtcttgaaaccatcccctggccctgtggaaaaattgtctcccatgaaaccagtctctggtgccagaaaggttgggtagcactgtgatatagtattaaaagtgctaataaatatggcatactgcctttaaaatgtctggtagctctttctcagtggcactcataatagtgttttttgatttttaaatgtgtgtcaagctgactctcccctccgtgtatgctgggctttattttccctttcctagtcaccagttttgggaaatagagatcttcattctcatgctgctcctctagtgcaagtgctccatttatttttaaggaattaatataacaaaaaatcatgggaatttagaaaacaacatggaagctaatgatcacattggtggaagtgatagggaaatatttagggggagaagttaaggtataaactttgtcaatgaagtcctattaaaaacaacaaaaaagtgaagcttaggatgcattttataaactctgaccagaacacctgtgtttctctgtttctaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttataggcaagttattagcaaggtctactcttacaattaactttgcagtaatactagttacactctattgattatgggcctgccctgtgctaagcagtctgcattccatcttccttgccaaaacttataatacaaatttcatctttattttataaataggggagttgggctgggtgtggtggctcacgcctgtaatttcagcactttggaaggatcgcttcagcccaggagtttgagacaacctggccaagtgagaccctgtctctacaaaaaaaaaaaaaaaaaaaaaattagctgggcatggtggcacatgcctgtagtcccagctgctttggaggctgaggtggtaggattgcttaagcccaagaggttgaggctgcagtgaatcttgatggcagctgcactgagcctggtgacagagcaagatgctgtctcaaaataaatttaaaaataaaataagagaattaaagtttagcaggttgggtggcaaaatgaggccacacatttaaagcccctcctcctgattcttttctctgccttggctgcctcctgtggcattttaggtgctgagaaatgaaaacagtagggaaaatagttccaggatcctcatgttaatttgccagaaatggcatcttcaagtcgtcagagggatctgagagttccttcctggcctgacttgagaaaatccgtctgtccccagctctgcgtctgcctccactgcccagtcacctcctctccatgctcttggggctgggccctaccccaccatgcagtgctgccctggagcagtgagcttggtgggtcctgtctggcatgagagctgcctttgggagctggatcccagcctctaccactgggtctggtgcctagcaggctatggataaacttctgctgactccggcctctcctaagccactgcaacgtggtcggtgtagtgcacagtgtgtgtgcagcgtggccttactcacagcctccacattagagagaatctgactgaagtcttactgctgcctcgtgtgaacataaatgtttgccagaaccatgagcaggaaatgttaatctgccttgtttcctgtcctttacacggaagaatttttttctgtatggaatgcgtgccttacaaataatgagtggaaatacccatcgctaatgaaaagttatacttgactgttagtcagctaaataatctgagatttctaatacttttaatttggcttttacaatgcaatttatcttagcttttttgatttcttaggtcatatctttagaactatatatttgaatgttaatgtaattttcatattgaaattaaaatgttgaactgcgatgttaagtgtttcctgtggaaaaacgttcacattttctctagttttaaagttgaatcaagctgtttgaagattttcacatttcttctagattttatcagcttgttactttatctgtcactttctgtgatttgcagctggagggggttcctcatgcagccctgtcctttcaagaaaacaaaaaggtgattatttcagaaatcagagtcttgtgttgaatcttactgattttcttgtatttctgtaatgtaatgtatcttgtatttcttgtaatactgtattggactctgtgtatatctcttctcagatgagtgattatatgtgtgaatgttgctggaatctgataaccaggcctgaatagttttgtagggtggcttttaaaaattactttcatatcagaattgctttgtcataaattttgaacgcatcataaatttctaatgttcggggtcagcagactttttttgtaaagggacagagtgtaaacatcttagctttatgggccatatggtctcttttgcaacattcagctctgccctgtgacaggaatgcagttgtaaagacatgagctactggccagctatgttccagtagaactttacttacagaaacagacaggctgtagtttgccaatacctgccttagggaatgtgttgttatattttgtgagttaccttctcagtaaattttatttagtattagtcaggaatattattaagtagcttcttttccagcctggtcaacatagtgagacccggtctctaccaaaacaaaacaaaacaaaaaaacagccacgcatgtggcatgtgcctgtagcctcagctgctgctcagggggctgaggcaagaggattgtttgagcccaggagtttgaggtcacagtgagctgtagtcatgccactgcactccagcctaggcaacagaatgagaccttgtgtcttaaaaaaaaaaagtttcctttgttgggttattttaatttggacctggttatcatttttcagccatatttaactttgtacatatcagaatgttctgataaaacttaacttttattaaagtgtttgtgatataatctgctagttttggtacacattatcttttgcaatgccagttattttcttttccagtgtgggtttgcataggaaaagaattgctgtcactttctattttgaaatcttaaaagactgatccttttttgtgtcatgatttgagtatttaattgagagcctaatgcctaatattatttgcagtattaaatgggatcttaacaggaatagcattctagccttcattgaattaagtaaacatttcttaagagaacttggaatctataatatttgcgtcatcatagtatgagatacttaatcaagtttgagattttagtgaaacattgtttagaagccaaaaggattctaggaaaaattaatgtctatattcttgaattaggagagattttgggacgtgtgactaagttacgctgacacttgtttgtttcttagtcgctttttccagtggcggtgagaacgaagatgactgattcacattgctcagatgagtttatcctcttctggctgggacatgggatatatcctgtctcttttaagcctttttggtatttttcccccattgagagctgtgtcttcaaactcttctgttatagctggaaaatcctttttaagtgaaatctgcccaaattataagacagatgaaggtagagttgtgttggatataggattagggtgaaagtagtgggggtgtcctggagcctctcttctggtggcagcctagctcttgtgcctttgaggaaattaccctggggacggctctgtggaacatatttgcaaaccactgatttggaagatagagatggcttttgttaagatctgaattcacctttttggcattttatttgatttctcaaggtaaagaacttattttgtaataaagtttcctattatttagtagataggccaagttgctgtgttaattccatgtagattttgggtttcctttgctcattttttcactcttaatctcacatcattgtaagtttatggaagttatcatacttctgactttttctttgaagagcagaaattagaaattcccaataattattttgatagtgtcatttaatgacactcacatgtgatgtagccacaaagatttaatgagttcagttttaaatcatattaagactgttggtttcatttgttctcattaatgtaattctgaagatgaacaataaaatgtatttttagaactttcaaatgaaatattatttcatccttccagatcatataatgcttaagttctgattgttaatcataaagtctagaaaattaaaagataataaaatgaaagtgacttttaggtattagagttttattataaattctggtgtgtcattggagctatgacatgaatatttcaaaggccaatagcattggatctttacagttataacttaccatttttaagtttaagtagtaatatagattatttaataatcaaaatcaataaatattaattattaaaatgttttgtggtatagtttgagaatcattgcttttaactttttccatataggtttattgactttaatagcattctaaacataacatctctacattctttgtgtttaatactgtggaggtataaaaatacttatatatgatgataaactatattagagtaaattaaatattcttatgagtttcattttagagtgcatttacttaattttgaagtccttatttttagcaaactaaaaggaatgttggtacattatttactaggcaaagtgctcttaggagaagaagaagccttggaggatgactctgaatcgagatcggatgtcagcagctctgccttaacaggtagttctcactagttagccgctggtgtggaccttcactgtctgccttccaccccttgcccttcctgctcgtccccctgcacctggtggacagcacgactgggggcagcagtggagccaggttgcttaaatggggcatattcgggcttcttttataatacttactctgaagcttgtgtgtctgtggtgtttgcatcatatatttgttgttttccatggtttaggctgttttaaaattaggtttatggcttgagcatagggctttgtgagtaggggatggcaggtcgaaacatctcatgagttggatgggttatgctgggggttgggaaatgggatgaaaaattatgggatgaaaaattgcctatggatagtttaacttgaaagaatctgcctttgtttacagatagttatcttttttcttttttgagatagagtctcacactgtcacccagtgcagatacccagtgtcactggagtgcagtggtgtgctcttggtgcactgcagcctccgccttctgggttccagcgattctcctgcctcagcctcccaagtagctgggactacaggtgcccgccaccacgcttggctaatttttgtatttttttgtggagacgggtttttgccatgttggtcaggctggtcttgaactcctgacctcaagtgatctgcctgcctcagcctcccacagtgccgggattacaggagtgagccactgtgcccggccagttacagatacttatctaatgaaattctctgtgtactttataaaagatgaggattaactgaaggtactaataactggattatatgagggtggttttggttgtataatcctatctaaaagaatattttagctataactgaaagtaagacttaaatatttagagaggaaaatctgaataattctagtagtaattatttatttacaaaataaaaatagatttttttttgattacacaaattaaacaacaataaaacatcacagcaatccggatactataaagctcacatgcttaccgacccaactgccccaggagtgaccactgccaacagcttcatgtcgacctttttgccataatttttatatagccttttttgtttttaaatggtaatttagaaagtcaactaggaaaatgtgttacaggtttatcttccaggagaataggactggagtcgagatcttgaatgtggcttggaagaaggcaagcccaccccagagagatgagttgacagttgtttctgaccactgcttgcttagagggcctgcgtgtctgtgaccgcctagctttgcgcccctgactaggctgccccttaattacaaatgtctttatatattgctccagctaaggcttggagtagtcggttaagaacttgaacttcggtttttgcagtgaaacagcatttgagaatatcaccttctgataagccttattttataaggtgggtactgtagtgggaggcagtgtgagagatgcttgaaggatgcactgctgtcctgcatttcagcatcttcaggatgctgtgcagctgaaacatttgataacggtggaactgttcgttattttgcaagcctgtgattccctattgaatgttttctctcgccatttgacaaatgagtgtttctctgtcttcagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtaagtgggcagaggggcctgacatctttttttttattttttatttgagacagagtctcactccatagtgcagtggaggccgggcacaggggctcatgcctgtaatcccagcactttgggagactgaggcaggcggatcacttgaggtcaggagttcgagaccagcctggccaacatggtgaaaccctgtctctactaaaaatacaaaaattagttgggcgtggtggcacatgtctgtagtcccagctgttagggaggctgaggcaggagaattgcttgagcctgggaggcagaggttgcaatgagccgagatcgtgacactgcactccagcccgggcaacagagcaagactccatttcaaaaaaaataaaaaaataaagtgcagtggctcgttctcagcccactgcaacttctgcctcccaggctcgagcgattctcccgcctcagcctcctgagtaggtgggattacaggtgggcaccaccacactcagctaatgtttgtattttcagtagagacagggtttcaccatgttggccaggctggtctcaaactcctgaccttagatgatccacccaccttggcctcctaaagtattgggattatagttgtgagccaccatgcccggccctgccacctgccatcttttgagttcttccctggagacctagacctgaaccctcctgcttgttctcttgttatctaatacccctattgacagcgcagcttagatcattaatggagagcttgacctcatctgataccttcactgaaggaaacaacttagtgtcttttgtgttgaacactgaggtaaaaaattggaatagttgattatatgaactctgctaaaattgagtgcattttacattttttaaggccttgttgggccctggttaaataattatttttaaaaatccttaaggagcctattataaacagatctgtggtcttaatgaaatgtgattaatactgtgcattattttaagaacttttgacttttcaaaaaacttttacaacatttcccatttgatagcggcataggtttaagcacttctcatctctaagttagtggacaaaaaaccctcatggatagtctaataatgtttgctacaagtccatgttgagttttatactccattttattttcagttttaaaaactgtggttaaatatgtgtaacataaaatttatgttcttaaccattttttgcgtatacagttcgctggtattaaatacatttaaataatgtcatggaatcattgctaccacccatctctgtaaccttttgatcatgtaacactgaagctctgttcccattgaactctattcctcctttcccgccaagtccctggcaaccacgattcttctttctgtcttctgaatttgactactttgggttctcatatactttaggagtcacacagtatttgttttacttagcataatgtccccaaagctcatgcatgttgtagcctatgttagaacttcctaatgtttcaggccaaatactattccattgtatggataggccacattttgcttttccattcctctgtccatggacacttgtattgcttcatgttttagccattgtgaatcatgctgttatgaacgtgggtgtacagatagctcctggagactctgctttccatttttttggctaaatacccagaaatggagttgcttttacattccaattttaatttaaaacattcatatcattgagtgttttacttaatagtatagtagttaacaaacttaataaaatagtattttggtaataatttgctggtagtccattgttcagtttttttaggtaaattacacaggacatttcaagtggacatgaaacatcttgtgatgtggaatcatgccccaagctgatggctaaacatatgaaataccataccctaaatttagtagatttagtctttgcaatttaggagataacctgttatattgttaggtttttgtcgaaaagctttgtcctcatatttccaacttgctgtaaaatttgtttgtgaagacaaatatttttgtatgggttttttctttttcatattaaaaagaaatgtccacattggaatttttttggagtttttagagctaatagagcttttcataatgtagtgggaatgagtgatcagtaagctcttagcagtttccatgcgtgcatttctgtgccttgaaataaatgacagatgagtacatttgtgttctgtgtgtaaaatgtgctctttcctcattgcacttccatgttggagggcttgtctcttggtgatcacacttcaaaattctcacagccccccttgaaccgtttaggtgttagacggtaccgacaaccagtatttgggcctgcagattggacagccccaggatgaagatgaggaagccacaggtattcttcctgatgaagcctcggaggccttcaggaactcttccatgggtatgtggactacaggtgatgcgctacaaagtggtttgtattcagacctggacatcttaattatatctttgcttccaagaagaagtcctttgatactgttttctgagttctgaatagctgatgaaaatgaccaattgaggaataatcatactttttcttgatctaaatcttatacttttgagttatcttagcataaatgtataattgtattttaagtggaaatttgtcacttaatcttgatttctctgtttttaaagcccttcaacaggcacatttattgaaaaacatgagtcactgcaggcagccttctgacagcagtgttgataaatttgtgttgagagatgaagctactgaaccgggtgatcaagaaaacaaggtgagggacataggcttgagacgacttggtgtttctgagcttgtgtgaggatttaaaatcgccctggctactgtctactttattgctttcccatccctgggcctttaaatttcccctttaaataccagctcttcccaggcctgttgttttctgcctttccaggtactacccacagccttgagaattgcctgagttctgcctcctttgagagtgtgccccagacaaatctattctgtactgaatgtttccttgtctgatttcttggatcattcatttgatggttgcgtatggcctgcaacgtttcttgttttggttctactgaactgttctaaaagtctctcttcatattatctttttacatgtaaatgtaactgtcttcacttttaattcctcaaggacaaggaatagcgtttcacagttcgtcccatcaatcagaattatagcctttggcatctccctatctaccaggcccacttcctcttagatttgggcttccccaggctgttgcctttccccaagtagcttctgcttgtcctgtagaagacctttcatgctttgcttctgcagcagccgttcctgaatgcctagtgtcaactgccttcttaccacgcccaccctccctgcatgctgcatttatcccctgccacagccctgtgaccctgtgtcctgctgcctctgacttgtctgtttctgcttggccatggtctctgtgaggtcaggtgtgcatatgggcacaaaccagggcatctctttatccccagcacctggcttaagtgctgctctggaactatctgttgaatgaactaatgcatgaatgtattgttgagtatgagacaaacaagtgtcattgtctcctttctagccttgccgcatcaaaggtgacattggacagtccactgatgatgactctgcacctcttgtccattgtgtccgccttttatctgcttcgtttttgctaacagggggaaaaaatggtgagtacaaaaggggatgtgcacagttgaaggaaataactaggtttcagaggtcagcttggtggcctgtttttgccttgcgtgcagcagaggaagtagaatctgaggatgagtttggttttcactagccgaggggagggaggaaatgatgggagcaggtaggttattgggtctggttttgttcatttgaaaacaatctgttgtttgaggctgaaggtggcttgggtgatttcttggcagtgctggttccggacagggatgtgagggtcagcgtgaaggccctggccctcagctgtgtgggagcagctgtggccctccacccggaatctttcttcagcaaactctataaagttcctcttgacaccacggaataccctggtatgttaaaagttcacatcttattttctcagatttaatcattattgtaaaaactatttcagtattgactattttagttttagagcagtaagtgttttgagttcatttgggatatttgacctgcgttgtagctcttcagaaaacacatgaatagtgaagttctttgtttcatgggttccctttagatgaaacccatagaggagaaaagtagaaacctcagcacgtaagagccaacatatatacacatcggatttaaacctaaagcacaaattgtgcctggtcgcagtggcgctgagtcgcactcagccaggccaggcattcacactcagggtgagtgggaaccaggactggctgaggcagcagtggacccaagtctccatcgcgcccatgcttactatggagccttctcgttctctctttttctttgggtgagagggtacacttgtgtttttgaatttatatgaggtaagtgtgtaatagggttttttctaatcttttttaagtggaatctggaattttaatcagatttattatctgacaacctagaattataatccagaaagtctgtggtattgaggacatattggcaatatgatgaatctctaattcttaaatcctgaaacttttttttttttaatcacttagggttattatagtgaagtcatttctgaatttggatcttctcttcacacctctttttctctttcctgagaattaagcttttgtttcgagttagaaagttgatagtagggaattgttccatggctgagcaatttatctccacagaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggtaacggccagtttttcagctgtgttttttctagttatgcttactaaggtttaagtttagatgatgatgtttgttgcttgttcttctggttaggaaatacattttctttggcggattgcattcctttgctgcggaaaacactgaaggatgagtcttctgttacttgcaagttagcttgtacagctgtgagggtgagcataatcttctgtggaaccatttcttcacttagtggacattttatcattgctacaattaaaattggagcttaataggaaatatttccatgcactctaaagctgtaaccagtaatacccaccatgtatccatctctcagctttagaaagaaaacgttgccagtaaagttaatgcttcataaacttcagtttaagttctaattctcagaatatttgtttgaaatagacctcttcctaaaggatatatttagaaataacctatcattaagtgtaaagtctgttgaatatgctgggcacggtgactcacacctgtaatctgaccactttgggaggccaaggtggaaggattgcttgagcccaggagttcaagactatgggcaacatagttgaccctgtccctacagaaaattaaaaaaaaaaaaaaaaaaagtagctgggtatggtggtgcatacctgtagtctcagctactcgggaagctgaggtggaggggggattgcttgagccccagagatcaaggctgcagtaaggcgtggttacaccactgccctctagcctgggcaacagagtgagactgtctcaaaaataatagtaataataatcagttgaattaaaaaaaaaaaaaaaaaaaccactgtgctaggcccatagtatggtaagagttaaagtgagccttagggattatttactcaacctctgtttctgtataaagtggaataggctcaattctttaagtgatagcatgttgaacctttccataccaactggctcataagtcacaactggccagtcaacaagagtaaaaattaactggtaaaaatcaaagcaaaaaacctacaattgtcaaatttgtgggataactcccccttttaaaatgtcatgcctgacagtaatttctctctagtttccaggttttcagtcagttgtgtcttttttgagcagaaggaagcatgctaagagctcaatcttgtggctagctgggggtctttgtgtcagccatgcatgtgatggtgcccctgggtgcttggggctgcaggggaggggtacagcagtaggggcctgttctgttctctcgtgctgtggagtacatagtgacatagtggggtggtccttggtgtaggtcccttgttcctacccctgggtctgagatttatttagaagtggtgttggggctgtgcggcaggcccctctgtaactgatcaatgtttgtgaagttgctgtttgagagttgaaaccatgacataagcagaaatggaaggaagaaagaaccagttatgtgaaagggacacatttacttttaagcttgtatttactgagataaagtattcttaatcaatgttcttgagaggtgtgggaaaaatgcaacatcctggttgcagttaaacccagaacattgtgtgttgaagagtgacggttctcaaaccgtcaagacgcgggtactgagtgggactaacctgctgtcctcttgccttggaccttgtgttccagaactgtgtcatgagtctctgcagcagcagctacagtgagttaggactgcagctgatcatcgatgtgctgactctgaggaacagttcctattggctggtgaggacagagcttctggaaacccttgcagagattgacttcaggtaagtgagtcacatccattagatttcatgaactaagctcaattgaaagttctgggatcacttgatgcaaggaatgatgttatcaagtaccctgtccatcagaaatccgagtggtttaggtagatgacagtgattttctcctcccagtggctttttgctgaactttgccctatgcttggaattttattttattttattatttatttagagacaagatcttgctctgtcgcccaggcttgaatgcagtagcacaatcatagctcactgaagctttgaactctaggactcaagtggtcctcctgcctcagcctcccgattagctaggagaataggtgtgtgccgtcacactggctaatattttttgtagaaatggggtcttgctatgttgcccaggctggtctcaaactcctgggcttgattgatcctccatcttggcctcccaaagtgctgggattacaggcatgagccactgtgcctggcctagaattttaaaatataagtagaagagtagatttttttttttggtagtcctcgtcatttaagtattctggatagtgggaataaaagagcttagaatttttcatctttgtcttaaacttttaaaaaaatgtagcttatattaattctgcttgtttaaaaagaatatactcttcattatactgaacctaggtaagacagctggtttatattttgttgcaattaaaaaacgtgagctgtggttgcagtgagccaagattgtggccattgcacttcagcctggcaacagagtgagacttggcctcaaaaaaaaaaaaataacatgagctgtgttggcactttcattttctaagagtagttttggctggagaagttttctttcagtactttcttttagaagggaaattttcctttataatttagggtttgttttttttttttccaagccaccttttatagagcccttgtgggttatttcatttaatccttagaatgtttataaatctgggcttgttctcggctccacccacagatagggacgctgagcgtgcatgagtgggcagcaagatagcaggttatggagggcccagctcaccccttctgtggcttgagccaattttatagggcacttacagagtcttttgaaatagtatttattttgaagaaaaagaaaaacagtttactgagtactgtcttattgagtctggaattgtgagaggaatgccacctctatttatttaaagccattggccttttttgttgttttgagtaagtgctgcccaaggtccttccagggcacctggatgagcctgctctggagcaagctggcggtaagtgtttactgagtaactaaatgatttcattgttaaatgtgctcttttgttaggctggtgagctttttggaggcaaaagcagaaaacttacacagaggggctcatcattatacaggggtaagcggtttatttttgtgagatgctgttttaccttcaagaaggtgaaagtgaggctttccttgtggaatttctctaaatgcattcgtcatgttttagatgtttatttcacagtttatatcatgaaagttataatcttgtcatatggatttaagtctagtaatgttgagttctttctcactagctttccaaaatatcttacctaaaatttagtcaaatacaagattatgtttatttttattatccttctctctaaagcttttaaaactgcaagaacgagtgctcaataatgttgtcatccatttgcttggagatgaagaccccagggtgcgacatgttgccgcagcatcactaattaggtatttaccaatattttatctcttttccttttttggttgaagtactaaaagatacgagaatggaaagagagggaagaattcaaaggatgtagagcagtattcctgaatctgagctcatttcagccattctattcttaaactataatgaaaaaaaaatccaaaaaagtctaaaattataattaaaaaaacaacaaaatactaactgtccattgtaaaaagtaatgcactttcattgtaaaaattttggactatagagaatagtactaagaagaaaaaaaaaatcaccttcaattctgctgccacctggaggtaatcactgttaatattttgctatatactctatgagtttcttgttcaaaatcaggtcaaaattacatgcaattttgtaatctgacaatttccacttaatattttattagcattttcctgttatgaaacagtaattttagttatgggtcgttgttttgctatgcggttgggataaaattttatatactttttttggcaattacttattatacataaatgtttgtgtatagttttctttttctgagaattcctggaagttgagttaccaggcccggctttgaatttttttttttattttttttttgagacagagtcctgctctattgtccaggtgctatctcggctcactgcaacctctgtctccctggttcaagcgattctcctgcctcagcctcccgagtagctgggattacaggggcacaccaccacgcccaattaatttttgtatttttagtagagacagggtttcacgatattggccaggctggtctcgaacttctgaccccgtgatccacctgcattggcctcccaaagtgctgggattacaggcgtgagccatggcgcctggccaggctttaaatttaaaacaaatcttctaatagctttatggaggttataatttacatttcttgaaatgtactcactttgagtgtatagtaaactccaattttatcacatttctgtcaccccaaatgtatccttgtgcccatttgctgtaacctccggttcctgccccaactcctaggcagccactcatctattttctgtcccttaagatttgtgttttcgccaggcgctcatgcctgtaatcccagcactttgggaggccgaggttggtggatcacttgaggtcaggagttcgagaccagcctggccaacatggtgaaaccttgtctctactaaaaatacaaaaattagtcggatgtggtggcacacgcctgtaatcccagctactcgggaggctgaggcaggagaatcacttgaacctgggaggcggaggttgcagtgagcagagatcgcgccactgccttccaacctgggcaacagagagagactgtctcaaaacaaacaaagatttgtattttctggacattttatagtactggggtcatagtatagatggacttttgcatttggcttcttttacttaattgtgagattggttcttgttgtagcatgtatcagtagtttgttcatttttattggcgaaagtattctattatatgaataataccatattttatctatccatcagatggatattatagagttcatgttttggctaatttatgaattatggtactgtgaacatttgcctgcaagattttgtgtagacatgtcttcatttctcttgagtagatcacctagaagtggatttttaaataattttggtacttactgtgaaactgctcttcaaaaacataccattgttccttccttccttccttccttccttccttccttctttccttcctcccttcctccctcccttccctacttccctctccctttccctttcccttccccttttcccttccccttcccgcctgcctgcctgcctgccttccttccttccttccttcgtttctttctacatatacacatttttttaaatttcaatggtttttggggtacaagtggtttttggttacatggctgaattttggttacatggtgaagtctgagattttagtacacctgtcacccgagtagtgtaccttgtacccaatatgtagttttttgtccctcaccttccagccttccgccttgtgagtctccaatgtccattataccacactgtatgcccttgcgtacccacagctcagctcccacttctgagaacatatagcagaaacatgccaaagtatactcccactaccagaatgtgattgtgcctgattcttctcaccagtacaaatatttcaaaaaaagttaaatatgtatcagttttttgggcagaagttgatacttctctttatttatttattttttttgagatagggtctcattctatgatgcccaggctggagtgtggtggtgcgatctcggctcactgcagtctctgcctcccaggttcaagtgattcccacgtcagcctcccaggaagctggaattacaggcgagggccaccactgccagctaatttttgtattttttggtagagatggggtttcaccatgttggccagactggtctcaagctcctgacctcaagtgatccacctgccttggccttccaaagtgctgggattacaggcgtgagctaccacacccggctgatatttctttttaaaataacttaccttcttttgaaagtaatacatgtttaatgaacagaatttaaggaaaatataaaaaaacgaaataatctttgtaatcaaactactgaaaagaaaaccaaagttacattttggtgcatattctttttcattttcatcattgtaatttgcatttctttgattacttgtgagacactcctttcatttacttaataggtttatatgacttgcctattcagagattttgcagctttaccattttctgcaaatgatagcaacttctttttgtttgtttgtttgtggagacagagtctcgctctgtcactcaggcaggaatgcagtggtggaatcttggctcattgcaactattgcctcctgggttcaagcgattttcctgcctcagcctcccaagtagctgggattacaggagtgtgccaccatgcccggctaatttttgtatctttagtagagatggggttttgccatgttggccgggctgatcttgaactcctggcctcaagcggtccccctgtctcggcctcccaaagtgctgggattacaggcgtgagcaccgtacccagccagtagttacttcttatattctagaaaaaattctactcatgatcaagtctccatgaggaaagagactttaattgaagatcatggggcttgcagaccaatatgataaaatagttcattgtttctaaaagtattactgagtgttgatggcagatatgaacccttttgtttttgtaggaaaatgttacccgtattctccatttgaattcagtttagatttgttaggaatcgcagcttaagctttgccatctgggagtgtttgggacagttttgcagacaaaattgcaaaagtgcctaaggaatgcagctggcattcagacctgctctgtgctcagtactctgtggacagacactgttcagcacttgttgatcagaaggtttagaaagagaactttcaaagttggtttttaattaaagcatttaatagtgtaaatagaaagggattaaattttatgacagacaaaagaaagtacagcacccagctgggcgtgggggctcacgcctgtaatccagcactatggggggctgaggtgggtggatcacgaggtcaggagttcaagagttcaagaacagcctggccaaggtgatgaaaccctgtctctactaaaactacaaaaattagccgggcgcggtggcaggcgcctgtaatcccagctactcaggaggctgaggcaggagaatcacttgaacctggacggcagaggttgcagtgagccaagattgcaccattgtactccggcctgggccacagagtgacattctgtctcaaaaaaaaaaaaaaaagaaaaaaagaaagtacagcacccagttatgtccgagtgggtgcatgagagtgaccctgagattggagacaacgctgtcacgtgcttgaagaacgccacctgagaaagggggcgagaagtggtgtccgctggtaaccagaggtgttggcttagccatctgcagggaggagggtggtctatcacaggtgagtttcatctactttcttaagcaaattaaccttacttttgtgttaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccaggtatgctgacccagtggcatcttcacattgtcgggaaaatgccctttcctgatgcctttctttaggctttaattgaaaacattttattttctagaaaaaagcttcagctcaggatgtttgagtgtaggtcagtcctttgataggatattatcattttgaggattgaccacaccacctctgtatttaagctctgccacaatcactcagctgtgacactgtaaatctcttaatagtttattacattccatgtgctgacagttgtatttttgtttgtgacacttacgtattatctgttaaaacattttcactttagttgtgttacctttaaagaggattgtattctatcatgcctgttgattttttggtgagcgggctattaaagtcagtgttatttagggttatccactagttcagtgatttgcgagattatcattcacatttattgtggagcttttgaatatcgtgtcaaatggccacatatatcccattcttatctgcttcttaggtgagtgggacacagtgctttaatgaagctataatcttcagaattctagcttgcagagaagattgcagaagtgataagacttgtgctttttaattttgtcttttaaatgttattttaaaaattggctttatatgatactctttttttctgctgagtaacagtgttttacaaaacttggactaaatgacttctaagcttaaatgatcacttgatgctttttttctgaattaggaactcagcttatcaaatatcaaagtcataattcctgaataaataacgtcttttttcatgtaaagactgctttaaaaaacacatggaaggctgggtgcggtggctcacgcctgtaatcctaacactttgggaggcccaggtgggcaggtcgcttgagctcaggggttcaagaccacccagggcaacatggcaaaacccacctctactcaaatacaaaaaattagccaggcgtggtggcgggcccctgtaatcccagctactcgggaggctgagggatgagaatcacttgagccccggaggcagaggttgcagtgagccaagattgtgccattgcactcccagcttgggctacagagtgagactctgtctcaaaaaaagacacacacacaaacaaaaaaaacatggagacatttttttggccaccttaatatttcccctcagataatttcctttgtttaaactcagaactggcattttctctcttggagaagattcaggacaaatactcctttaagataagtagaagcagtgaaagaggatttgattatcaggaatttgataagcttagaataaattgttgcttcttaatgtcatttcagaagatgaatatttattaatagatgccaactgagatatcattaaaattgattactaactactacttggaaaagtctcccagttccaaacttcagcaggcctcttgacaattcagctgtggtcaattgggtcttgcgtgatagatacaatgaccaattgtgcagcagagtgtgctgcttagctgcctattctgttagcattcatgtgttaacttaaaatcataatctccttagttttgttgagtgtctccgtggacaagacactgtgagggatacaaaatcagattggctttattcaaaccactggggtattataattcatttataatttattttattttttgccttttttccatgtgttctaaaggaattagagtttgtatataactataatgggggatagaaattgacatgtgccatgaagggaatgcaaaaaagtgccgtgggagatgagaagtggagaaaggaatttcttttttcttggaagcaggaataacttcatgaagcatgtatttcaacttaaacagatagtaggcaacgctgtaaggggagtatggctgcagcaaaagtgttcggggcagactgggaggaagggagggaataaattcagccattgttatggaataatgatcaaaatttattttcagcccgtttcacttaaaagttgagactgcttaactttttttaatctttaatcttaaacttttaaatgccatttgatctttaaaaatatatgttttaatagtgtattttaagtctctatatttttgttattagaatatatagaggctataacctactaccaagcataacagacgtcactatggaaaataacctttcaagagttattgcagcagtttctcatgaactaatcacatcaaccaccagagcactcacagtaagtctctttcttgatcggtcttactgacattgtaatagtttttggtagcttgtatggccagttagttgtatggtcatcttacggtgaggtgcttgtcttacagctcttacttatccatgaggcttgctaagaaattgtgcttctgtgaaaagaatctcagcttactccaggaatgtaaatgactatgttttttctgattattaaagtaatacacgcccaaaataaaaaaattcagccaatttaggaagacacaacaattaaaataagccaggcatggtggctcatgcctgtaatcccagcactttgggaggccaaggttgggggctcacttgaggtcaggagtcggataccagcctggccaacgtggtgaaaccccatctctactaaaaatacaaaaattagctgggcgtggtggcgggcgcctgtaatcccagctactcaggaggctgaggcaggagaatcgcttgaacctgggaggtagaggttgcagtgagctgaggtcaagccactgcactccagcctgtgcaatagagcgagactctgtctcaaaaaaaaaaaaaaaaaaagaaaagaaaaaagtaaactactgtcacctgcattggtaatgtatcagaagtttaaaatgtctagattataattaactcagtgacctggtaatatatactaagggaaaaatatttataatttacatttttacatttttatttttttaattttattattttttttttgagacagagttttgctcttgttgcccaggctggagtgcaatggcatgatctcagctcaccacaacctccacctcccgggttcaagcaattctcctgcctcagcctcctgagtagctgggattacaggcatgcaccaccatgcccggctaattttgtatttttagtagagacagggtttctccatgttggtcaggctggtctcaaactcccaacctcaggtgatccgccctcctcgaccccccaaagtgctgggattacaggtgtgagccaccatgcctggccttacatttttataataagaatttatgttgctgacattagaaaagaaccataatatccaagaatccaagaataattaaattatgtacatatgctagtatatagtgtgatgctttggagaatttttaacaatatggagatgtataatctggattgtaatattgagtgaaaaaaggcagaatacaaacctggtgggggtatagtcggatttcagttaagaaaaataatatttacatatatacatttctcacactggcagataatcaccaagataaattttgggattgtggatgatttttttcttctttatatttttcagatattctcaaattttctaaaatgagcaagtataacttttgttatcagaaaaaaataatatacaaaagtaatgttaatttgctggtgaccaggttaaacctttttatttttattttttgagatggaatctcactctgttgcccaggctagagcacagtggcatgatcttggctcactgcagcctccgcttcctgggttcaaatgattctctggccccagcctcctgagtggctggaattacaggcgtgtggcaccacacctggctaatttttgtatttttagtagaggtagggtttcaccaggttggtcaggctggtctcgaactcctgacctcgtgatccacccacctcggcctcccaaagtgctgggattacaggcgtgagctactgcgcccagccagacctttttattttatttgacaaaagaaatacttccatgttatagaagactaaatattgtttgggctgtctgcagtatggtcttcccttgatttgttcaaaatatcgtaaactttgcttatttatttttattgtggccgactgtgtcgggcactgttgtaggcttgggatggaaaaacaggattcctgcccttagggtttctgcaggctggtcagggagacgatgtggtaagctggagctcagctcctaaggatgtgcaggggcagttgagaggcggaagggtgggagatcattccagggtgtgggcagcacaggaacctctcttcattgggatataattgccattctgataacacgtgtttgaggtgtctaaagtaggaagttgtaccatggtgggacagatatcctgtggttatcatacacagatctcagttttcttctcattgtttgtactttttataaagggtaacaggagatataattcaataaacctttgtggtgtttgggtgtgattttattgtttctttcttctcagtttggatgctgtgaagctttgtgtcttctttccactgccttcccagtttgcatttggagtttaggttggcactgtgggtatgtattttcctcagtatatattaatagttgtctacaacagtatgacataaacatagttattaggatgccctttttctttctttttaagtcttttatcaatttggctttttggaaaaatatctgatggaatacttgtttctgctatattagctgtgtgagactagtgacaggagctgtgggaaatgaatgccaaatgttcttaggcattgatgggaatttcagggtgtggtcttcaagttcatttaagggaattttcatatgctggcaaaaggcttttctcattagcttgactctttccaaaattatttgctgtgaattagaagtttaggaaccttttttcacttaattgtgacctagcatacgaaatggtgatgatttaggaactactgttcttgtattaacagcttttatttaaaaatgattttcctccagtagatggccctactagcatctgggaaataatttcaagtcttctccagcattcaggaataggctttcattttgtgtatcaattactgagaatgattttggtgactcacatcacatttgagaagtaaacctgcagatttcttgtgtgtgtcagcaaatgaccaactgatatttgcttgaagtggattacattatctgctctagaatgattgctttcccaccttcctcacatacagactgagcagctacggtttctaatcataggtctggcactagacttcacttctgggcaactttggcattggagtaaaatgtattaatttaaagaaagttaaaaatccgttcaagtaaacatacagttctaatactttttacaatttaaaatatagatttaaatgataaaataaaaaagaaaatatgggtagacaccataatcctcgtttctgcatctgttcacaaggggttgatatttatgagttctattctccatatccattctatgttctcttaatgctcagtcagcacctcaggtggttggagttcaatgcttggtagtttgacttacactgtcttttctaggggattgagccctgggtagtcctgcttatttgaggttgcaatttgtctttcaataacttttactacaagatatggcgtgttaaaggataccattggggaaccaacataataatatcaggaaaactaaccacgtcagacctgccccattgtgtatcaagtacactatttttccatagtaataaagagttcaccccagccaattctcttttattttgtgcctgtttactcaatggcattaacatgcccaaatgtctgggtagctgtctcatctccagttcagcagaaccattgtcatatgccctagtaaaagcattccttcattggacacttaggccccaatactttcattcagatctactacctgatttcatttctcaaatgatttttatggagctctgatttataggaaagatgttagttgattaaaaataaaacaatttctgagctggtataaaatgtattgtgacatgccttcctcttggaattgcaagagaaaggaagactgttgtttgcttaaaaattgtctataatttgactttgcaaatgtctgcttccagagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcaggtactggtactgagttgaaacagggactccaggacttggattttgatttccttagggggaatgggggtggtgagcatatgaggggaaaatactataaggtcattgccagtgatggcttgtccctttagtcaaatttcagatgttacctatatgcataaacacatgcagttggcagctgttctgtgctgagtattttaaagtagcctcttcccaatatagcccctcagttaactacaagtaaactcattttgaatttcattttaatgggcaccatatgccagtactccctcgggcactgggatgttaagaaagtataatgtatggacttcattctcaagttagttttagattagagggggatacacgtaaacaaaagtgcagtggtcacacagagtggccctaatcactctccttgggcagatttatgggctggtaggaaagagcacaacacggagagggtgtagcaccttggcgatgataatggaggatgtggccagcaaggaagacggagtccattgaaattgattttgggagaagttgccaatctccatgaaagaattggggcctgtgctatttgcttcagggggctataggagagtttcgtgaaagggactaaaagatgagtattttaataagatcattcatccaacttgaacatgggctggaggagaaggtagggagactcaggagattaatgttgatgctaaggcaagataatggctttgggactgtagggaagacactgattgtaagagaatgaaggaggcagaattgccaggcctggttcaccaactgaacttcggttgtgaagacaaagaaacctgggatgacttcacatcctgggcaggtgtgtggtggtgacagtcatggaaattgggaacacagatttgtgcgggaaacatcagtttcagtttgagtttggcttatcagttgaatatcaggcacagatgtctggccaactctcaacatagggtcttaaatgacttcagttccccaagcaatttgtccttcccatgctattggggtggagaggtaatgtctgtgcccatatcacagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggtaatgtcccacttgggtgctggattcatacagccttaatgactatgggtttccagactacctttgtttagtaatctgtcccttctttattctctttttgctttaaatgaacaaaattgctcagattgtgacactaaatttaacatcaaaatgtgaccatgtggatgggtgcagtggctcgtgcctgttattccagcactttgggagactgaggcaagtggatcacttgaggccaagagttcgagaccagcctgggcaacatcacgaaaccccctctctactaaaaatacaaaaaattagatgggttgggccgggcgtggtggctcaagcctgtaatcccagcactttgggaggccgaggtgggcggatcacgaggtcaagagatcaagaccatcctggctaacacagtgaaaccccgtctctactaaaaatacaaaaaaattatctgagcatggtggcgggcgcctgtagtcccagctgctcgggaggctgaggcaggagaatggcgtgaatccgggaggcggagcttgcagtgagccgagatcgtgccactgcactccagcctgggtgacagagcgagactccgtctcaaaaaaaaaattagatgggcatggtggtgcgtgcctgtaatcccagctacttgggaggctgaggcaagagagttgcttgaacctgggaggcggagtttgcagtaagccttgattgtgccgctgcactccagcctgggtgacagagtcagactctttccaaaagaagaaaaaaatgtgaccatgtgttttatagctcttttagtatcatcagtcactgttatccctaagagggaaatacctagctttagttttaggtttccagcattagccaagaaagctcagaattgatgttcctggccaagtacctcattgctgtctccttaaatcttggttaatggctactgtcctggctagcatagttatggagcatttccatggttgtagaatgttctgccaatctcagggacagttttgcttttctgtgaagcaataaaatcaacttcaaaacaaatgttaactatttgtacaatggatttaagatagaccagttcacatacttttttttttttttttttttgagatggagtttcattcttgttgcctgggctggagtgcaatggtgtgatctcagctcactgcaacttctgcctcctgggttcaaacgattcttctgcctcagcctctcgaggcagattacagctgggattacaggcatgcaccaccacacccagctaatttttttgtagttttagtagagacggggtttcaccatgttggtcaggttggtctcaaactcctgacctgaagtgatctatccgcttcggcctcccaaagtgttgggattacgggcatgagccaccacgcccagcctaagatagaccagttcacttactgtttatatctgattactctctctttgccttgtcttctacctttaaaaatctccctactaacttcccattctcctttagctgccatcagtcttctcccttctctgcaaacatctctggagagtcccagcctcagcccacagagcttcccactgctctgaggtggaccttgtttgcaaggcttctttggctctcttggcctggaccctgtctactacttcagccatccttccttaacccctgctggtggtttctgttgccacactccatagcagcgtttcccgcccagatcatgtctttacatctctgggcactgctctggtcctgcctgcctttccctctttgtatcctgcaggctgctacccccatcttgagtgtcctcttcagttggctttcagagggcctcctgggtgttcccttacccacttgccactccccagtcactgggttcagtccttcctgcccaccagcacatgctttctaggctctgtcctaggccgtcttctctctttgtagtctctgggccagtgctgttctagagagtggcagaattttctataaccatggcagtgctccatagctatgccaggcaagacagtagccactaaacacatatagctgttgagcccttgaaatgcagctagtgtgactgaagaactgaaccccgattcggtttaattttcattaaatttaaatttaaataaccttatgtgggtagtggctccagtattgggcagggcagcctgagagtcggggctgttctcctgtcttcagtgtctagatgagggacctcagaggacctgtctctggagctgcagttcaatgtagccagctgccccgtgacacttacatatagctgatttgtggatatgtcagacacggtgtgatgagctcagctttctgtcctcctccccacatctgcccctgccccatttaccccactttgtgtcttatcaagctagaaacaggtcaccacaagtcttcatttccactcaccaagtcttttgtttcccctactaaatattttgcgagaagaaagtgtgtacctttgtattcacatacatgtacatgcacatatacatgcacatatgcaggggtccccaacctctgttaaaaaccggactgcaggccgtgcgtggtggctcacgcctgtaattccagaactttgggaggccgagaccagtgcatcacaaggtcaggagatcgagaccattccggctcacacggtgaaaccccgtctctactaaaaatacaaaaaaaaattagccgggtgtggtggcgggcgcccatagtcccagctacctgggaggctgatgcaggagaacggcgtgaacctgggaggcggagcttgcagtgagccgagattgtgccattgcactccagcctgggcgacagagcgagactctgtctcaaaaacaaaacaaaacaaaaaaaaaaaaaaccaggctgcacaggaagaagtgagcaagcattaccatctgagctctatctcctctcaggccagtggtggcattagattctcataggagcgtgtatgagttcgttctcacacttctgtaaagacatacctgagacatataaagaaaagaggtttaattggctcacagttctgcaggctgtacaggcttctgtttctgggaaggcctcaggaaacttgcagtcatggcagaaggtgaaggggaagtaggcacatcttcacatggcccacaggaaaaagagagaaggagagagagagagagacagagagagagagagaaaaagaaagattgagagggagagaggagggagaaaggagagtgcctgtagggggagttgctacacaaaggagcaccagggggatggtgctcaaccattagaaactacccccatgatccaatcacctcccaccaggccccacctccgacactggagattacaattcagcatgagatttgggtggggacacagagccaaaccatatcagagcatgaaccctattgtgaactgcacatttgagggatctaggttgcatgctccttatgagaatctaatgcctgatgatgatttgaggtggaacagtttcatcccgaaaccatcccccgccaaccctggtttgtggaaaaattgtcttccacagaaccggtccctggtgccaaaaagtttggggacctctgcacatatgcatgcacctgtacatggacacataatacatgtacatatgcatactttatattctctgccacttctggtccagactgatatactatctcatttggattactgcactagccttttgttttggaaacagcattttttaaaaaatttaatttaatttttttgagatagggtgtcattctgttgcccagcttggagtgcagtgtcatgatcatagctcactgcggcctcgatctcccaggctcaagtgatccttctgcctcagccttctcagtagttgggactacaggcatacccaccatgcccagctaattttttgatttttttttttttttgagacagagtctcagcctgtcgcccaggctggagtgggttggcgcgatctcagctcactgcaacttctgcctcccaggttcaagtgattctcctgcctcagcctcccgagtagttgggattacaggcgcctgccaccacacccagctaactttttgtatttttagtagagacggggtttcaccatgttggccaggctggtctcgaacttgtgacctcgtgattagcccgcctcggcctcccaaagtgctgggattacaggcgtgagctaccgctcccagccaggaaacagcattcttgagataattcatataattcacccatttaaagtatataattcattctctttagtatgcccacagagttgtacagccatcaccagaatcagttttagaacccataaaggaactctgtactctttacccaaaacctccatgcctccagctgcaggcagccactaacctgccttctgtctctgtgactctacgtcttctggacattactgtggatgggctcatacagtcagtgagcttgtgactggtgccttctaccaagcagggttttcagtgtagcagcctctctgtttttcttttttttttaaattgtgacggaacttctgcctcccgggttcaagcgattctcctgcctcagcctcccgagtggctgggactacaggcccatgtcaccatgcctggctaattttttttttttttttttttagtagagatgggtttcaacatgttagccagggtggtctcgatctcctgacttcatgatccgcctgcctcggcctcccaaagtgctgggattacaggcgtgagccaccatgcccggctaacctttcatttactgtctgcatttcttccctgatgccttccagtccatgcacccgattgtagccattcatcctattatggtttaaggtgactgtcttagtcagcatgggttgccataacaaaataccatagcctgggtggcttcaacaacagaatttacttctcacacttctggaggttgggaagtccaagatccaggactttcgccttgccctcatgtggtgagggggtgaggaagctctgtggggcctcttatatatggatgctaatctcattcatgaggggtctgccctcatgacccagtcacctcccaaaggccccacctcctaataccatcaccctggtaattaagtttcagtgtataaatttgggggactatagacattgaaaccataacaagcacttttctaagatcagggagtgagtaagtagcagagctaggacctcaattccacatgtcagtcatcttgccttcactctgctccatgatggctgcctcctagagcattgggagtctcgatgttctatatgctctcatgtgttgtgtattggagatagttgaggctttatgaatacatctggatttgttgacttctagctttgctggtaaccagctgtgaccttgaataagttacttcatctctgagcctgtttcctcttttagaaacaggagtttaaaatgctgctttgggttgggcacggtggctcatgcctgtaattccagcactttgggaggctgagatgggaggatcactggagcttggagttcgagaccagcctgggcatcatagtgtgagatcctgtctcctcaagaaattaaaaaattagctgggtgatgtggcgtgtgcctgtggtcccatctactctggaggctgaggtgggaggattgcttgagcccaggaggttgaggctacaatgaaatatgattgcaccccatcctgggtgacgagtgagaccctgtctcaaaaaagaaaaaaaaaatgctgctttgtacccctttcatgtcatggcgtcatggccaacatagaatgccctggttgtttgctgttggagggcatgggcctgggggctccctgagggctccttccatcttcaactcattctctgtgcacctgttaggaagttgtgggccagtccctaccatgtatcattgtgtgggtaaaagtaaataaaatgtgtacagtgtctgaactgtacatatcagggtccaagaacaaaatgagtgacatgggttagctctttttaataaatggtaaaaccaaatattctaattttcagttttgttatacttccatcacatgtttttgtttttttgttttttgtttttgtttttctattttaggcagccttgccttctctaacaaaccccccttctctaagtcccatccgacgaaaggggaaggagaaagaaccaggagaacaagcatctgtaccgttgagtcccaagaaaggcagtgaggccagtgcaggtaggaaacagcgtggggaagggagggacatgagtgcagcatctgtcatgtagaaacataggatttaagtaacttggtgttttagagaaataaatataatacacatcagtaaagtgagagaaagtttctccaggtgcggttcaagatattagaaactaatgactgatgtacacagaccaccttttggtctgaagcatttctaagtgccactggctgacatgcagcccctacagcctccaggcttccagccctagcatggagcatcactctcctatgcttccctggttgcaggtgatggctggagaggcctcctgattttcagtaagggaagtggtgtagatgcttaggaatagatgtagtgagtgaaaaaactgattctgatatgtcaaaaattctgattggaaatggaatatttacatttggaagagctaaaggcgagagaaagtggggataaagtcatctgagttggaggagcttaaaccattcacaagtttggaggacctttttttacccatgaaaaggtcagaacagaaggggctaggatttaggtgtgactgcagtttattgaattcccatccatactgctctcggtgggcagtggcaggggcaggagaggagcctggcaaagcatgaagtgactgctgctgcctctgctatctgggacgcctggccacctgtctgtacagtctccctccagacccattctcacgctgtctcttggcacccaggggccagtgatggttctcccatttgttttgtgtatatagcatttatatcaaggctatttatttatttatttattttatttatttatttttttgagacagagtctcactctgtcacccaggctggagtgcagtggtgcaatctcggctcagtgcaagctctgcctcctgggttcaagcaattctcctgcctcagcctcctgagtagctgggactacaggtgtgcaccaccacacctggctaattttttgtattttttattagtggagacggggtttcaccttgttggccaggatggtcttgatctcctgacctcgtgatccgtccacctcagcctctcaaagtgctgggattacaggcatgagtcactgtacccggcctatttatttatttttaattgacaaaattgtatatatctgtaatatacaacatgatgtttgaaatatgtgtacattggccaggcgtggtggctcacaccttttatcccagcactttgggaggctgaggtgggcggattacgaggtcgggggtttaaggccaaactggccagcatggtgaagaggtgcccctactaaaaataccccaaaaaaaaaaaaaaaaaaaaaaagccgggcatggtggctcgcgccagtcgtcccagctacttgggaggctgaggcaggagaattgcttgaatctggcaggtggaggttgcagtgagctgagttcatgccactgcactctagcctgggcgatagagcgagactccgtctcaaaaaaaaaaaaaaaagaagaaatacatatgcattgtggaatggctaattaacctgtgcatcacctcacgtatcattgttttgtggtgagaacacttaaaatctactctttcagtgattttcttgcatatggtacattgctattaactgcagtcaccatgctatacagtagatctcttgaactcattcctcctgtctataaatgaaattttgtatccttgaccaacacattcaaggttttttttgagatggagtcttcttcacccaggctggagtaccatggcacgatctcatctcactgcaacctccgcctcccaggttcaagcaattctcctgcctcagcctcctgagtagctgggattacaggcacatgctactgcacctggctaatttttgtatttttagtagaagtggagtttcaccatgttggccaggctggtctcgaactcctgacctcaagtgatccgcctgccttggcctgccaaagtgctgggattacaggtgtgagccactgcacccggcctcaagcgttttaaaagatgctcttttctaaggattgactgtagtacaggaggaagattgacctgttgaaaagcctcagcctttacaagtgtaaaattatcagtatattactatcatctttctgatgaattaaataaactaaggactccaagtcaaaagtcttcaaactgaagtagaatagttgtatatagtgcttggcactttaatatttagtatcggtttaatgataatgtttgtgcctttgccgtctttaaaacatttttacatcatccctgtttgattacttggtgtgctcatgaagttgttggccactaaggaatcttaggctcagagaggttctggaattggccagtggtccttgaatcagctgctcctatgattctctaactgatttctcacaaagcaaacaagcaatcataacaaaacaactgtgcacactgctcttcttattttgttatttaaaaagtacttaggctctacttatgtttgttagtcaatttctcattacttctagttaatcaaaaggtcagaggaaatacttgaatattttcatactagaatactttaaaaaatcatgatttccagtaatctctttaaaacttggcaagttattttgatctaaaagtttatcttttgtgtgcatatttttaaagcttctagacaatctgatacctcaggtcctgttacaacaagtaaatcctcatcactggggagtttctatcatcttccttcatacctcaaactgcatgatgtcctgaaagctacacacgctaactacaaggtatgggcctctgcatcttttaaaaatatatatgcacacatacttacgtctaatggatagttgatgtttttcttatgatttgtaggatgtataagccctttgagatatgagttacatttagttttttcaagtttgtttgtctttcagctttgtttatgatagcttctatcatacaggtgttttggattttcatattgtttgtactcacagctaagattgattacagtgacagagctaggatgtgcagccaggttatagggggaagtggccctggtggagtctggagggatccgtgtacaggcttccttccctcccgtgaggctcacacaaaaatacagcaacatgctggtcctgcaggtaccctctgcctaacatgagccacaattccagactcacagaagaaaagcaggtgttcggcataaaccatgtgtttcaaatagtctgggcatggtgagccacttgttatcagctagggaaagtttatgtcagcgtaagaaactgttcaccagatacccccaagagccagcctttctgtctagggatgttttagttttttagttcatttttttttttaactttaaaattttctgttcatctgcaatttgttagatatgaagtatgtgtctaatttaatttttgtttttggttgtccccaataatgtttacagaagaatttttctgcactaattggcttgagttacttacattctcatagttctctagtttcagtagtttcatttattattttgttatatcaatctatctgtctgctcatctattagaagcatccttgttttttttttttcttttttagacagagtcttgctctgtccccaggttggagtgcagtggtgcaaccatgcctccctgcagtctcagggctcaagtgatcctcccacctcagctcctgagtacctgggactaccggcatgtgccaccacacccagctaatttttacattttttgtagagacagggtctccctaagttgcctgggctggtctcaagctcctggcttaagtaatcctccctccttggcctcccaaagtgctgggattacaggtgtgagcaactgcacccggctacaagtatacttcttaattattgtagcttaatggtatttatgaggggatcagttcccctgttgttctttagaattttctggatattcttctttattgattttgggatgtgaacaatagaatcaacttctacttgtagattgatttagggagaacttatacctcagatgttaagtcaccctgtccagaatgtgggatgctttcctatttgttcagaactttttaaattacctcagaagcacatgaaatttaaaggattttaaaaaaaacttaaagattatttcacatagctcttgcacatttcttgataaatgaatcctcaggtattcctctgtttttgttactaatagttacttcttatgggttttttttcccctgaaaatcatttatcaaacgtatgtggcttattttctgaaggatgtttgataattttggaagatatgaaagtcttcatattttacaaggtttgaggtctctttaagctgcatggttctcatgtcagctcccaaagcagaagacggcatgttgaaaaatgccgtagagaagatacttcttttccacctgttttcaactcatatcatcttgaatttcagggcacctttccatgctcctagtgcttgctatctgtttattattttccttcctgaataccctgaactccagcatgttctgctgtaattctggcctccctggcatcttggactcctgtttcctttgctctgtcatccccgcggtcagctcctgctgcgcagcttctcagctgaagtgcgtttggagtgcctggcgtgtcttgctggatctttgagtattgcctctggtttccttggttccttctgctgagttgctcagcgtctccactccccatttcttgtgtggcccttcctgcactcctctgattccttttgtcttccctggtttcttgctttggtttcgagtctccacagaacttttgcagctcttctgaagacctggaagctttttcatcttaattctcatctcatgacctcttttcccttctttgagagctagaacttcccatggtgaacttctctttccagaattccatgccttcttttccctcccacttacctgttgtccaggagaggtcagattgctgtgcatattggaggagaaccctttcttccctgggctcttcatctcacatgacatcaccacatcacctcgttccttggaccctcagtggtgtcactgctggatttttctttcctttggctggccttagggcacacccaggttgactagcgtagtcatggtatttagatccactcacattttcagtttctgtgtctgtctcttgcctgcttctgacttcgcccagagaaagcttctctttcacaagggttcttagatttatgttcactgagcaccttcttttctgaggcagtgttttaccaatatttattttcctagtcagtctcgccttacctttcttgttatgcatgtctttggtcctgacccattctctgagtctgtaaaatagaattgctgtataatttaattacatgaaatcctttagaatcttaacacatcttacacctgatttaatattttattgtatccaaattgaaccaaccctatgtgaatttgacagtgatttctcccagggatcctagtgtataaggaataggacttagtattttctattttttgatataccacataccagatactgattatgatggacatttaacccttttttctcattatgaaagaaagttaggaattatttcttccagtagcgccagtgtaacctgaaagcctttgaaagagtagtttttgtatagctatctgaaaggaatttctttccaaaatatttttccagtgctgacaacaaacacgcagacacaccctgcaaggtgagtgtacggcgccgcacagtggaggcatctgctgcagccgtcgatgtttgtgtctttggttgtacattatgagatcgtgacagggccagtaaccgtgtgttctctccttcaccttcccaaggtcacgctggatcttcagaacagcacggaaaagtttggagggtttctccgctcagccttggatgttctttctcagatactagagctggccacactgcaggacattgggaaggtttgtgtcttgttttttctccttgggttgtggctggcacacttgatgtgcgtcttctgggctgagttcatctaggatggagcctggttctccagggtgcctccgggagactcctccctgccccacgtgcttgcgtcacaggacccaagtctgactctgccttagccatgaagtttagggggaagtttctatttgtattctatttttgtctgttatcatgtattagcttagacccagtttagtttggaaaatcagtgggtttcaaaatgtgtttgtagagtcctttatttcttaacttgaccttttcaagtggaaaggggcaaaacagacgggtaagggggcggggcgggaggtgtgacttgctcttttgtgcctgaggaagtaacagagctggggttgacagtcatattctctgacacagatagtctctgacttatctcacagaaagtcagcggcagagcctgagttaaaagtctcgtagattttctttttcttttttttggtggctaatttcagttttatttatatttgtttatttatttattatactttaagttctgggttacatgtgcagaatgtgcagttttgttacataggtatacacgtgccatgatggtttgctgcacccatcaacccatcacctacattaggtatttctcctaatgttatccctcccccagtcccctcactccccatgggccccggtgtgtgatgttctcctccctgtgcccatgtgttctcattgttcaatttccacttgtgagtgagaacatgcggtgtttggttttctgatcttgtgatagtttgctgagaatgatggtttccagcatcatccatgtgcctgcaaaggacatgaactcatccttttttatggctgtatagtattccatggtgtatatgtgccacattttcttaatccagtctatcattgatggacattcgggttggttccaagtctttgctattgtgactagtgccacaataaacatacatgtgcatgtgtctttatcgtagaatgatttataatcctttgggtatatgcccagtaatgggattgctgggtcaaatggtatttctagttctagacctttgaggaatcgccagactgtcttccacaatagttgaactaatttacactcccaccaacagtgtaaaagtgttcctatttttccacaacctctccagcatctgttgtttcgtgactttttaacgatcgccatcctaactggcgtgagatggtatctcattgtgattttgatctgcatttctctaatgaccagtggtgatgagcattttttcgtatgtctgttggctgcataaatgtcttcttttgcgaagtgtctgttcatatcctttgtccattttttgatggggttgtttgcttttttttcgtaaatttgtttaagttctttgtagattctggatgttaatcttttgtcagatgggtagattgcaaaaattttatcccattctgtaggttgcctgttcactctgatgatagtttcttttgctatgcagaagctctttagtttaattagatcccgtttgtcaattttggcttttgttgccattgcttttggtgttttagacatgaagtctttgcctatgcctatgtcctgaatgttatggcccaggttttcttctaggatttttatggtcctaggtcttatgtttaagtctttgatccatcttgagttgatttttgtgtaaggtataaggaaggggtccagtttcagttttctgcatgtggctagccagttttcccaacaccatttattaaatagggaatcttttccccattgcttatgtgtgtcaggtttgtcaaagatcagatgattgtagatgtgtggtggtatttctgaggcctctgttctgttccattggtctatatatctgttttggtaccagtaccatgcagttttggttactgtagtgttgtagtatagtttgaagtcaggtagtgtgatgcctccagctttgttcttctagcccaggattgtcttggctatgcaggctcttttttggttccatatgaagtttaaaatagttttttccaattctgtgaagaaagtcagtgatagcttgatggggggatagcattgaatctataaattactttgggcagcaaggccattttcacgatattgattcgtcctatccatgaacatggaatgtttttctatttgtttgtgtcctctcttatttccttgagcagtggtttgtagttctccttgaagaggtccttcacatcccttgtaagttgtcttcctaggtgtttcattcccttagtagcatttgtgaatgggagttcactcatgatttggctctctgtttgtctgttattggtgtataggaatgcttgtgatttttgcacattgattttgtatcctgagactttgctgaagttgctaatcagcttaaggagattttgagctgaaccaatagggttttctaaatatacaatcatgtcatctgcaaacagggacagttttacttcctctcttcctatttgaataccctttattgctttctcttgcctgattgcgctggccagaacttccaatactatgttgaataggagtggtgagagagggcatccttgtcttgtgccggttttcgaagggaatgcttccagtttttgcccattcagtatgatattagctgtgggtttgtcataaatagctcttactatgttgagatacgttccatcgatacctagtttattgagagtttttagcatgaaaggctgttgaattttgtcaaaggccttttctgcatctgttgagataatcatatggtttttgttgttggttctgtttatgtgatggattacgtttattgatttgcgtatgttgaaccagccttgcattccagggatgaagctgacttgattgtggtggataagctttttgatgtgctgctggattcagtttgccagtattttattgaggattttcacatcgatgttcatcagggatattggcctaaaattctctttttttgttgtgtctctgccaggctttggtatcaggatgatgctggcctcataaaatgagttagggaggattctctctttttctattgattggaatagtttcagaaggaatggtaccatctcctctttgtacctctggtagaattcggctgtgaatccatcctggactttttttggttagtaggctattaactattgcctcaagtttagaacctgttatcagtctattcagagattcagcttttttctggtttagtcttgggagggtgtatgtgtccaggaatttatccatttcttctagattttctagtttatttgggtagagatgtttatagtattctctgatggtagtttgtatttctgtgggatcggtggtgatatcccctttatcgtttttattgagtctatttgattcttctctcttttcttctttattagtcttgctagcggtctacctattttattgatcttttcaaaaaaccagcacctggattcattgattttttttggagggttttttttcgtgtctctatctccttcagttctgctctgatcttagttattttttgtcttctgctagcttttgaatttgtttgctcttgcttttctagttcttttaattgtgatgttagggtgttaattttagatcttttctgctttctcttgtgggcatttagtgctataaatttccctctacacactgctttaaatgtgtcccagagattctggtatgttgtgtcttcgttctcattggtttccaagaaaatttttatttctgccttcatttcgttatttacccagtagtcattcaagagcaggttgttcagtttccatgtagttgtgtggttttgagtgagattctcaatcctgagttctaatttgattgcactgtggtctgacagacagtttgttgtgatttctgttcttttacatttgctgaggagtgttttacttccaactatgtggtcagttttagaataagtgcaatgtggtgctgagaagaatgtatgttctgttgatttggggtgcagagttctgtagatgtctattaggtccgcttggtccagtgctgagttcaagtcctggatatccttgttaattttctggctcattgatctgcctaatattgacagtggggtgttaaagtctcccactattaccgggtgggagtctctttgtaggtctctaagaacttgcttcatgaatctgggtgctcctgtattgggggcgtgtatatttaggatagttagctcttcttgttgaattgatccctttaccattatgtaatggccttctttgtctcctttgaactttgttgatttaaagtctgttttatcagagactaggattgcaatccctgctttttttttgctttccatttgcttgttagatcttcctccatccctttattttgagccaatgagtgtctttgcatgtgagatgggtctcctgaatacagcacaccaatgggtcttgactctttatccaatttgccagtctgtgtcttttaattggggcatttagcccatttacatttaaggttaatattgctatgtgtgaatttgatcctgtcattatgatcctagttggttattttgcccgttaactgatgcagtttcttcatagcgtcagtagtctttacaatttggcatgtttttgcagtggctggtactggttgttcctttccatgtttagtgcttccttcaggagctcttgtaaggcaggcctggtggtgacaaaatctctgcatttgcttgtctgtaaaggattttatttctcgttcacttatgaagcttagtttggctggatatgaaattctgggttgaaaatactttttttaaagaatgttgaatattggctcccactcttttctggcttgtaggatttctgcagagagatctgctgttagtctgatgggcttccctttgtgggtaacccgacctttctctctggctgccctttccttcatttcaatcttggtggatctgatgattatgtgtcttggggttgctcttctcgaggagtatctttgtggtgttctctgtatttcctgaatttgaatgttggtctgccttgctaggttggggaagttctcctggataatatcctgaagagtgttttctaacttggttctattctccccatcactttcaggtacaccaatcaaacgtagatttggtcttttcacatagtcccatatttcttggaggcttggttcatttcttttcactcttttttctctaatcttgtcttctcgctttatttcattaatttgatcttcaatcactgatatcctttcttctgcttgattgaatcggctgtcgaagcttgtgtatacttcacaaaattctcgttctgtggtttttagctccatcaggtcatttaagctcttctctacactggttattctagccattagtctaacatttttttcaaggtttttagcttccttgtgatgggttagaacatgctcctttagctcggagaagtttgttattaccgaccttctgaagcctacttctgtcaattcatcaaactcattctccatccagttttgttcccttgctggtgaggagttgtgatcctttggaggagaagaggtgttctggtttttggaattttcagcctttctgctatggtttctccccatcattgtggttttatctacctttggtctttgatgttggtgacctacggatggggttttggtgtgggtgtcctttttgttgatgttgatgctattcctttctgtttgttagttttccttctaacagacaggcccctcagctgcaggtctgttggagtttgctggaggtccactccaggccctgtttgcctgggcatcaccagcagaggctgcagaacagcaaatattgctgcctgatccttcctctggaaacatcgtcccagagcacgaaggtgtctgcctgtatgaggtgtttgttggcccctactgggaggtgtctcccagtcaggctacatgggggtcagggacccacttgaggcagtctgttcattatcggagcttgaatgccgtaccgggagaaccactgctctcttcagagctgtcaggcacgtatgtttaaatctggagaagctgtctgctgccttttgttcagatgtgcccttcccccagaggtggaatctagagaggcagtaggccttgctgagctgcagtgggctctgcccagttcgagcttccctgctgctttgtttacactgtgagcatagaaccacctactctagcctcagcagtggtggacacccctcccccagccaagctcctgcatcccaggtcgatttcagagtgctgcgctagcagtgagcaaggccccatgggcgtgggacccgctgagccaggcacaggagagaatctcctggtctgctggttgtgaagactgtgggaaaagtgcagtatttgggcaggagtgtactgctccttcaggtacagtcactcatggcttcctttggcttggaaagggaagtcccccgaccccttgtgcttcccaggtgaggcaacaccccgccctgcttcggcttgccctccgtgggctgcacccactgtccagcaagtcccagtgagatgaactaggtacctcagttggaaatgcagaaatcacctgtcttctgtgtcgatctcactgggagctgtagactggagctgttcctattcggccattttggaagcatcccttgttttttgaggtggagtcttgctctgtcgcccaggctgacgtgcatcggcacaatctcggcccactgcaacctttgcctcctggtttcaagcgattctcctacctcagcctccggagtagctgggattacaggcacctgccaccatgcctggctaattttttgtatttttagtggagatggggtttcaccacattggccaggctagtctcgaactcctgaccttgtgatccacccacctcagcctcctagagtgctgggatcacaggtgtcagccaccacgcccagccatattttcagatctccctctctttgccctaaaccactgtgcttaataagtagtttttagtggccagcagtctccatgtataacacattttagcaaaatggaaaatactatatgttttaaatttgaacgtgagattatactgaaataaaaatcatctaactgggattctttaaatagtaagattttcttttttgtatgtgggtttttttttaaccttattattatgactgtcatatatagaaatggctgtttttcagttacagtcagtgaatgtatcaaatgctgccttatccaaataataaaagtaaattattaataagtcacaatttaatgaagattgatgttagttgatctttatattcttgaaatcagccatatggttgtgtgtgtatgtatatatttttaaaggtacataaagataataagctcatctctgaaaatttttacatttggcataagaataactggataattaagcatcttattctctggcctgtgtctttacagttaaaggtagatttactcacctctccttttttgtttttctaagttcatcttttttgctgtttcaagacagaggcccattttagctttctcgcatatccttttgtttgtactttggaagcctcacctgcttaattgttgagtttttatccgtggtcttttagagggggatatgtagggtagaagctttcacaggttcttgtttgcacttggcccctgactgttttgaggaatctccctcactgactcacagcatggcaaggtttcagatctctttctgccacacagcagttctgaggcagctggaaagatatccagatgcttagattgtcaggccaggcttgagatatacaaactattgagccttatctgtgaccttgcttaggtgaaggcatcagagcccctgcaccaacatgcataggcctctgcatgtgtgcggggctgggtgttgaggtctgagcacaagtgtagctggagaggtgagcttgatgtggcgacgggtatgagcaggttttcttcagacttctgtgagtttacctagttccaggatttaaaggcacagagactttagaattaaaatagaatcattttctttttctaaatagcaacactaggaataaaaaataataattccacattcttgacaggtaatgttttttcttgtcttctaatccttatttattccatactcatttttatacataattgaaatgtattatgcattggatttttcttttgcattatattatagacgatttttcatgtaactccttactgttccattttatatgttttgtctggtttaagactttatctgcaaaccgggaaactgtctctacaaaaagaaaaacaaaaatagttggccgcagtggcatgcgtctgtggtcccagctactcggggctgaggtgggaggattgcttgagccttgggaggttgaggctgcaaagagccatgatcatgccattgcactccagcatgggtgacagactttatactgtctgttttgggtgatttgataatgatatgccctgatgtagtttttttatatcttgtgtttcttgtgcctgggtttattgaggttgggtctgtggcttcatagtatttttaaagtttggaaaattttaggccattctttctttctttctttcttttttttttttttgagacagtgtctcgctctgtcgcctgcgttggagtgcagtgacactatcttggctcactgcaagctctgcctcctgggttcacgccattctcctgcctcagcctcctgagtagctgggactacaggcgcctgccaccacgcctggctaattttttgtatttttagtagagacgaggtttcactgtgttagccaggatggtctcaatctcctgacctcgtgatctgcccgcctgggcctcccaaagtgctgggattacaggcgtgagccactgcacccagctaggccattatttcttcaaagattttttttctgccctgcctccctccttttttccctctcttaaaggggctgtgatttcctgaatgattgcttagtgttgtcccatagcttactgatgctcttttcagtgtttgattgttttatgtgttttctgttttgtatagtttctattattgtgttttcaagttctctgatcttttcttctacagtgtctactctgttgttaatctgttaatctgttgttaatcctgtccagcgtatttttttttttgtttttgaaacagtctcactctgttgcccaggctggagtttagtggtgcgatatcagctcactgcaacctccacctcccaggctcaagcaattcttctgcctcagcctcccgagtagctgggactataggcacgtgccaccacacctggctaatttgtgtatttttattagagatggggtttcaccatgttggccaaactggccttgaactcctgacctcaggtgattcatccgcctcggtctcccaaagtgttgggattataggcatgagccaccgtgtctggcccctgttcagtgtatatcactaattttgtttttatctctagaagtttgatttaggtcttttaaaaatgtctccctgtgtttctgtttagctttgtgaacacaattgtaataactgttttaatatccttctctgctagttctaagatcttctaataacttcccagttcttggtgtttctcattggttgattgatactcctcgttttgggttgtattttcctgcctctttgtatggctgccaattttttattggatgcccaaccttgtgaattttactttgttggatgctatatatttttgtgttcccatagatcttcttgagctttgttctgaggttagttgagttacatatagatggtttactcttttgggtcttgctttataatttgtcagatgggttggagcagtgcttagtttaggactaattttttttttggactaattattcctctttaggaataattaggtaccatgcttaggaggcaagaccatcctgagtactctacctaatgaaccagaaagtttgggttttccagtccgcctgctgagaacagtgactttctagccctgtgtgagcgctgagctctgctccttctaatcctttccaatgcttctttccctggcctcagggagttttctcacacacatatctctgctgagtactcgagagggaccttccccagatctccagagctctctctgtcttgttttctcttctctggtgctctgtcttatgaactgtggctgtcttggtctccttagattctcagcacctcttcaattcagagggttgcctgtccctcctccttgtgccacagcctaggaactctctcaaagcagcgagttggggcagccatagggctgacttagtctctcgtctcccagggatcactgtccttcattgctcatgtccagtgtcttgaggactctgggttttgtctgttttgttttttggtttgctttggttgtctcaggcaggagggtaaacccagtccctcaccctcattgtgctcagtagtggaagtctcactctattacattagatattagtatttgtagcagagccctggttccctggtacttggggagctcttgaaaggccagaaacagcatgctttctcaccttttccagggcttcagtttctggtgcacatcaagcattccatacacatttgttaaagtcctttgttagacaagtagtgattcacaggttctatttgtaattttttcagttaacatgtattgggtatctgctgggagctagtaaaaacaaaaagtggtgtgtgacaaattcaattctgacaagaacaaccttaaacacttagaatatactttgagcatatcagaattttaaaaatgtgtggcccttgagtatttgaaaccaacaagaatctattgcttattagtagaggatattttgttaaacaagtggagagagaggcattttcagtctaattggtgttggcttttagcagctgatggaaaccagttcgtgattagccaggcagtggtgaaacaggctgtgcattctgaatgcctaggtatctaggcattcagaatggtggcgctctttgagttagcatcttcttctttcttgattcttttttttttttttttgagatggactttcgctcttgttgcccaggtaacaactccagtgcaatggcgccatctcggctcactgtaacctctgcctccctggttcaagcgattctcctgcctcagcctctcaagtagctgggattacaggtgtgcgccaccacgcctggctaattttgtatttttggtagagatggggtttcactatattggtcaggctggtcttgaactcctgacctcaagtgatgcacctgcctcgatctcccaaaatgctgggattacaggcgtgagccaccactcccagccccttcttgattcttgaaaaggacattgggtgctgtacatctcgttatagatgttgataaaaatgcttgtgagaagagtaacattaaggtagttatttggtcatttttgcagattattttaagacaattctaggactgatttgtggtaaatcacacattgctgtatcatagttgtgttcactgaacatattcaggggctctacagatgcagggctcttagctgctttgcacacttctgaattcctgccctgcgaacaggactggatacctaatagacaacaggtacttgataacagtttattgaattaatgagtgaatgaacagatacataaatgcatgaaagaatggttgtaatgtatataacttggatttcaagactttttactgactgttcaaaataagaaattgaaaactttcctctgattttcctctactatttacacaatttaaatggaagttatcttgtaccttcaatttctgtctaggattcgtacaataacgggtcatctctgagtcgcttaatgtctcacttgtctttctacagtgtgttgaagagatcctaggatacctgaaatcctgctttagtcgagaaccaatgatggcaactgtttgtgttcaacaagtaagagcttcattcttttcctcttctgttaagacgttcgggtatgacagcaaaacgctgctactccttaagaggcaggcgctgttggcataatcagctgggaggattgtggggtccagcgcagcactttttggctcagtccatgattgagccaagaggccatccttcccttcactccccaggaggacgaggtctgtcactgtggagggcagaggacaccagaagctcctctgcaacctcgctagttaacttccagtccctcggagtttctgtttagaatgctcaatctcatttagaattgcaaggaaacccaaaacgcctatttaaggtacaaacagcacttcatacaatatctcatgaggtattaatagtgattcacaggaagaatttcacgctgtgagtctttgctaacatatccagttatttacagatggatttgatatttgtgtgggagattcttaaaagtgttgttcacgccacattgttgatgcctcatttttttcactgtagttgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcggggtaacagttgtggcaagaatgctgtcgttggtggaagcacgaaagagcaagcaggaaatactttgtaaaagaataaaaacgaaaaatgttagcgaacatcttctaatagtctgctgtattcagagaactctaggagatatatatggttgatgcaaagatgatttaaggcatagcccggccttccaagaagtgtgtggccagtgagtgagatgggcttgggacttacacatctcagaggtgggggtagaggaggaggaacactgagtgggctgagaagcagccagctctcattgccaaagtgtgtcagcaaaccagaatgcagttcataatgtccccacccattcaaagcacaggacctgtagagtggtgtggcatgtgttggtggcacttttcaggcctgtaacaaggatgaaagaacagcttcatagcagcacagtagtgctggtgttcagaggtgtgtgaaggccatagaagcatcttggatatattaccttgtgttttgtcagctttatgactagaagtctcttttcacttaaatttgttttttttttttttgagacggagtcttgctctgtcgcccaggctggagtgcagtggtgcaatctcagctcactgcaagctctgcatcctgggttcatgccattctcctgcctcagcctcccgagtagctgggactacaggcgcctgccatcacgcctggctaacttttttttgtatttttagtagagacggggtttcaccatgttagccaggatggtctcgatctcctgacctcgtgatctgcccgtcccggcctcccaaagtgctgggattacaggcgtgagccaccgcgcccggcctcttttcacttaaatttatgtttgtgtttttaatgcctagtatacaggacttcttaaattgccttaagtatgaacaggtatttgagttgctaatctgtatagtagcaataatagaatcccttgtttttccttttataaatttagcgattaaatagctacaattaaaacactagagtcaggagtcaaggaaaatacccatgttccaggctgtatgttagtgatgtacttactatatattggagtttcaggagtaagtctgtttcaatgctttctgtaaccatttggggtattaataagcatgtgagtgtgtgcatgtttgggttaatttcatatatgtttcttagaagggatatcattgatgtaaatattttaaaggcttgtcctccaaaaaaatcatgtaatttcttctaaattactgatcttttaaatgaccttcacctttctctcaaatctcacttaagactgggctgagtagtcagtttcctgtagcagaaaaaagctcagacttgagtagccttctgcgagtgaggagacttgatggctgtcaggcagctgtaaactctaaatagagtgtcattatctgaagagggcgatgctgccacactgagtggcctttcaagttgtttctcaatctgacacgttctgatcgtgtgaatgtgaaattggtttgagcaggagtatatctgagtgcagaggagattatttaaagatattctcattctctgcttcccttttattcccatttggcagatggtttgatgtcctccagaaagtgtctacccagttgaagacaaacctcacgagtgtcacaaagaaccgtgcagataaggtaaatggtgccgtttgtggcatgtgaactcaggcgtgtcagtgctagagaggaaactggagctgagactttccaggtattttgcttgaagcttttagttgaaggcttacttatggattctttctttctttttttcttttttatagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtttgtcacttttatctttcatccatcatacctgttcctaatttagtacaaattaccctaaaagacactgaaatctactttaaagaaatgtggtctgcatgtttccctcatcagttgctgctgcttatctttttcatgcacctagctggtgcagaaggcctggggcatagccagcctcagcaagtcagcatccttgccccagctccctggactcaaggctaacctggggttggctgttagggatttccaaaggtttgtcccatccacttgcctcccctccaaaataagtttgaatttaaattgtgagatacaattaagatttattgtttggggaacatttttgcaaaatctagagttagtttaaacagattatcaattattaccataattgatcatctgcagtttcaagctatctaacaggttcacttacctctttaaaaaggaatggaatttagcaggacagtaactgagacccgtgctcctggagtccatgtgggagctgtgtggctctgcacaagcatttgcacgcttcccctcttgactgcattaccttcctcctatagttgctgtgggcaccagattctggctagtcctgtcccttcatgatgcacattttcctcaagattcgtcccagttaaatcactgcagatgaaactgccttttcatcgtcaaaatttaactgtcatttttgagccgtgatcttgggctactttcttatgtggggtaggaatatttgtgagttagaaatattacacttctctatttccttctagacgtaaatctgttaatcctgtcagcactgttactcacctgaaagggtctgtttccctaggagaactgagggcactcggtcaacactgattttccacagtgggtattggggtggtatctgcttgttttttttgttgttgttgtttgtttttttttgttttttttttgagatggagtctcgctctgtcacccaggctggagtgcaggggtgcgatctcggctcactgccagctccgcctcagaggttcacgccattctcctgcctcagcctcccgagtagctgggactacaggcacccaccactacgccaggctaattttttgtatttttagtagagacgaggtttcactgtgttagccaggatggtctccatctcctgacctcgtgatctgcccgcctcggcctcccaaagtgctgggatgacaggcgtgagccaccgcgcccggcctggggtctgcttttaatgaaggaggcatcaaggggtgggctttgcgttggcctgatgctttcatctttctttcacaaaacctgtccgaagaaaatccgtctaaatgggccattgctctcctcaggaaatagtcattgggaacttcttttcctttcctttgacactaggaggctgactggggagaagccctggtctatggctgtgggcagcaggggctgagaggagcaggctctcaggggggcacgggtaccccaagggaagccagagccctgatttgttccattctagtaagaacaaagactgctctggtttcatgtttgttctgattgcctttcatcaaccggtcccctttctcccagttcttaagattcagtacagtgacagttttatgaacaagaatagaacactagaacagacaaaccattgaactctatgctgataaagatttattgagctcctgctgtatgtttgcattctgcccagaggctctgagaaaaccaggccatatgctccatgctttatccatggaagctccccgtcaggttgggaaagctgacagctgcagggaatacagtgtgacacaaaactggctcccatgcagcccttacgtgtcgcctctcagatggttgggggacgaaggtcgactcctttgggtatcttattactaaaccagtttcagggaatctgtgccaccctatctgccattaacgtgaacagatgagtccccaaggtgtaattttgggtattgtctgatgtctcttggaatttattatttgtttttccaatgagatttcacctcagggtatagtaaagttgttgaggggattcctggatgtgttctgcaattatctaggctgatttcagaatagagttatgcttatagtcaaatttatcagctgtcaagaattttatttaaaatttatgcagataagcaggaggaaaagaagcctggtttttacattttaatcctattattgatgtgaaattttattttccttcctgtaggtgtttattggctttgtattgaaacagtttgaatacattgaagtgggccagttcaggtaatagcattttattattttagatttttttcttcttcttgtgtacttacatgtaatttaggttattaagtgaatgtttaaactactgttaggcatttttgctgttttctttaaatggaaatctgactaacatactgtgcatttttgcttctcttaaaaattaatgtatatctcaagacttgtttggaagtagttatgtatctgaaaattccatatgttgtcagtattcattgcacatttcaaagcatttaattgtgttgacagatggtggaatgaaatcttgtggtggagcactagtttttaaatcttcttagagaaagcagttttatataatgttgtctttagtaattattatgcatttgtattctctgcagctttttcttgctagatgttgaggttttaatacttcttgctagtccattacaggtttataattattaaaagttaaaattcttttagtacctaaaatgcttaataaacattgtaattaggaaaatttagtgcagaaggaaagtgttcccagattccctggggtctggaaacatagtgtttattctaattacatgacacctccactgtgttttggggcaagttactgtttctcttttgagtttcaatttcttcaagagcaaagaggcagaggagagctaggaagatcgtagctgctgtgcccctgtgccgtcgggtgccttctacctgctgcctccgaacctttacacatgtccctgctctgcgcgagggcacagatgggatgcactgtggcaggggtggggttagagtagatcacggacacctgttagcttgatgtgtgcttgctgtcaaggttgaatcatgaattattttatgttgcttatattgatatgtatcttaattttaaaagaaaggtctaaatggatgtttttgtttttagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatggtaacgggacacacctttcactgtcgtcttcggtgtcgtgatgtgcttggcagtgttcgttttcatatacccactttgaacgttgtcagtggcagccatgtgcttctcaggctctgcatgtgtgtctgtgtatgtgaaggtactggttagagacgtttcaaaagagaagagagcatattctttactctcagcaatttgtaatcttctcagggaaaaaaattcaagaaacagtaagataacctaaggtacagatagattctgaatataaagttcctgttcattcacatgaaacgctaaaagttcttcacttgatcttagccaaaaggccaagaagcgatgcaacactaaaaattcttaaatcgaacttgccgtgaattaaattttgatctctcatccagtggtattggagatatagtttgacttgggttcagggctttctgttttgcctgatgattttgctggagcttaaataaggaacccaggagatggccagctgtgcaagcccccagcctgtggaaggagctagtgtggttttatgaatgagttgcaaatctttctttgagctttttgaactgatcttccagcattgccctattgacccctccctgactcctttgctggaatctgtaggcttttgaactttgacagggacacatcctaagacccttgcaaactcccagatgtgagaatggcactactacttagagtcttttcgactcagcgtgtgtgcagaagagcatcaaccgggctgtgttgcgaggcagggccttggctgacctctcagtgtttacatagctaagccagttagtgtttgccacggcctcacaagggcttcagattcacacagccaaagtatagattattaaaggcataggtgtttggtttcctggacttggagggtctttggacagaaaatcagtaggcaaccacacccagtactttgtgctgggaagcttggtcatctgtgagagggtcagagagtatacccatgcgtgcatgccaccgaagggtcagtgagtattcctgtgtgtgcatgtctcagggccggagagagtatgtgtcactgagaggtcagagtgtttgtgtgtgtgtcaaagagggttgcattgtgcccttcactgaggggtcagagggtgcctcgcgtgtgtgtgtgtgtacgtgtgtgtgtgtcactgaggggtcagagtgtgcctgtgtgtgtgcttgtgtgtgcgtacatgtcactgaggggtcagagtgtgcctctgtgtgtgtgctcatgtgtgtgcatacgtgtcactgaggggtcagagtgtgcctctgtgtgtgctcatttgtgagcgtatgtgtcactgagggggtcagagtgtgcctctgtgtgtgtgctcatgtgtgagcgtatgtgtcactgagggggtcagagtgtgcctctgtgtgtgtgctcatgtgtgagcgtatgtgtcactgaggggtcagtgttcctatgtgctcatgacattgagggtcagagtgtgcctgtgtgccaatgaaaggcatttcttatatttttttatatgtggtcatagtagaccagttaatttattttgactcctgtgttagaccaaaataagacttgggggaaagtcccttatctatctaatgacagagtgagtttacttaaaaaagcataataatccagtggctttgactaaatgtattatgtggaagtctttattgtcttttcagatgaatcaagtagattattcttgagaccaggaatgttgctgttttggttatttggaaagttttatcattttcaaattgacttttgaatttgagtcaccttttttcagaagtggtgttaaattataggagccctaggttttttttctttttttagaagtcatcacaaaatgatcagtgttcagaggaagagctttgaccttccacatggtataatgattgataaccttaattcatctcttaccataaaccaagtatgtgtaagggttttctttatttcttgaaagcattttgtagatgttgagagcagttttccaaatgtaatttccatgaaatgcctgataagggtacccttttgtccccacagccataccggctctgcagcccatagtccacgacctctttgtattaagaggaacaaataaagctgatgcaggaaaagagcttgaaacccaaaaagaggtggtggtgtcaatgttactgagactcatccagtaccatcaggtaagaggaatgtatgttggaactgtcgtggatactttattgacccgtgcagatggaaggaagtgccatgtggtaacgctcactgttaactgtgttactttgaaccaggtttgggctttctggggcctgggtagatgccggtgcagggggatggggagggaggcggggggtgggggggtgtggtggagttggggaggtgcagtggcaggaggtgttgttggtgtgtatcctttttttttttttgagatggagtctctctccgtcgcccaggctggagtgtggtggcacgatcttggctcattgcaagctccacctcccgggtttaagcaattctcctgcctccacctcccgagtagctgggattacaggcatgcaccaccatgcccagcaaatttttttttttgtatttttagtagagatggggtttcaccatgatggccaagctgtttcgaactcctgacctcaagtgatcctcctgccttggcctcccaaagtgctaggattacaggcgtgagccaccatgcccagcctggtgtttatctttaaagtgggcacagccacaggagttcacctgactcctggtctgagagtcacgagatcgttcaagatagtgaggccctcttttccaaaacgaggaccaaaaatcaattgacagtgttggtcaagatggtagaaaccttaaaatgatagaaatctcaactctgaaataaaaactttatttgtatatttatttaccactattttgacatagggctaaggtctttttctttgagctgatttctggttttgttttcttaaagtggcataagaattcaaagacattttgaggaaggctgagtgcagaaatctctctttttaaatgacttctcctttcttttaacttgcactgttgtctagccctcacttattttgtcaattctttttagctgtttgtctttgaatcttcataaagccatagcttttctcataagaagcagcactttctttgttcattcatattttaatgaacccctgtagtatttaattaaatacttaatgcctaattaaatcacataattgcaatgcaaaagtacatgtatcataaagaggtctgaaaatgagcaactggcaagcaggtggtggcaggcagagctgcttgggtgggtgggtgtcatggagaggagttcatcagccacatgttcagtgagctctggatatgtctgtttagaaatgatcactaataaacttgtgctcaaccatgtatacctctgggaagcaggtgctcttcagtagattgcctctgcagagaacacagaattgaagtgaatgtccacaaaggcaatgagccacctgcagaatagtttagtcaaggctgtgtttgaagtttgccaaagattaatatacatttgattttcatgttgtgccttttctctgattgtgaaatattacaaattctatacaaataacaatgatggcaaatcctcctgagcaaagtgtgcaccttgtatgtgccctagaggaacttgtgtttcgttctgattcccctacatttctcatgtcatagagtgggggttgcattagtgtccccctgtcctcgctgggatcacatctgtttggatcctagagtcttccagctgaactgggacaagtataacagacggacacgtaggggtggaaaggcgtctcttggcagcagactttctaattgtgcacgctcttataggtgttggagatgttcattcttgtcctgcagcagtgccacaaggagaatgaagacaagtggaagcgactgtctcgacagatagctgacatcatcctcccaatgttagccaaacagcaggtttgtccccgcagccttggcttgttgttgcatagtgatggtagcttaaggtccttgtgaaaggtgggtggctggaatcagctcttccttcagtcctaatctgtgccttgatagcagttctccgtgctagtcatgggacagctgacttcatttcttctcacaatgccatctcaggttggtattgcccacctactttacaggggggatcccacagctccgagaggttatggaggtgatcaggcagcacacagctttagagtgctggggtgagggcgggccaaggctaactctaaagcccgaacccttacctcctacactgcctcctgcattctggtcaacccagtgttttatttggtggttagatttttgtttttgttaccttactgcttgtaatttagcagttttcctttcctttcccttcctttcctttccgacagggtctcactctgtcacccaggctagagtgcagtcgtgtaatctcactgcaacaacctctgcctcccaggttcaaccaattctcccacctcagcctcctgagtagcaaggaccacaggtgtgcaccactacgcctggctagttttttgtatttttagtagagatgaggtctcgctgtgttgcccaggctggttttaaactcctgggcgcaagtgatccaccaaccttggcctgccaaagtgctggcattacaggtgtgagccacctcgcctggcctattcatcactaatcagaatttctatgatcaaatgacatgaatcattgtttccacaactgcagtggaaggaaatggcctggcagtgccagtttcagaagcagcctgcccccagtcaggcacaggccactgtgcccccagtgtagcagcacctctgtagctcacagagaagggtggtggggacctccttgaggcagctctgccagaaaatctcatgagctgcctggcacagcttgaggttgccttttaagtggactcagcaaatacatgtttgttcatcttgattatacacaataaacaactactctgtatagtacgagtagtccgtggtttttggcatttgatttaaacttagaggcatgtgatattgatgttactgccttcatgactgcacccccattctgatttcataatggaatgttatcttgagaccagttagacaacaggacagggatcttggcttctggtgagattgacagcagttttagtgtggtcagggtctccctgcctacagatggttttagaatggtgccctggaagctttatcccattcttttctgtgcgtaatctgagtagagtggagatcgaaggcctgaatacatagtaaatacctgacttaatatctgccgcaatggaaattgtgtgatacaacatttatgaaacgcttagtgcagcacctgccaggtagctcaccacaggtgcatgttgcattcagaagtagtgctagatactatcctgttactggcagtgcatacatcagtgatcaaagcagattaaagaaagaccccctgccttcttggagtgaagattttgttgggatgcgggtaaggggacagacaatagaaaagcaagtgagtgaagtctataccatggcggctgatcaggaacaccgtacagaagaatccaggagggaagagagttaggtggtgtctgcggtgggagtggcattgttcagctggtgatgagaagaagctttggtgatctggtgacatttgagtgaatttgcagaaaggaaagatacaagcctaggagatacctggggaaggaacattccaggcagagcaaatagcagtgcaaaggccctggcggggggcggacatgctgttagggtacaagcaatgagggtggaggagtggggcagccatggggagggaagggagtgaggcctggtggggtgaggccagtgtggaggagccttgagagggtttgcgctgatgtggtgtaggttttagcaggatcattcttattcctgagttgagaatagccttgagggggaggtgagggcagagcagggccacccatgtgagacccggcactggagtggaatggcccaagtcagcatcccttggcagcatgaaagcaaaaccagcaaggtttgctggtggcttagatgtggcatgtgagagagagcagggctttgggggtgatttcagggtgaggacagggtggctgtggacaaggtagggcagacattgggggcagcaggaggtcagagcctgtctggatgtagcagttgagaccccataggtgcctaatgaggtgaggccagcatcaggtgtatgagcctggagttgtcgagagactgtggggcagggggtcagcatctgagatgtccactcacagtggacccagactggctggagaggaggaggagcttgaataccgagcctgctgagtcccagctccaaggtcaggtaggtgaggggagccagtgctggggcagggggagtaggcaggtgtggggttcctaaagccaagattttttttaaggcattttgtgcaggagggcgacatctgctgtcagcaccttgggaacttggcccaggtttggcagcaccgagggcactgatgagtgcttttggaggagcaaagggagccaaaccctaatgggaatgtgttcctgaaaggacaggagagagacttgggaaaaggttttacttgaagagggaacggagaaatagggcagtagccagaggaggagaggagtcggcaatgggttaagttggcagaaatgaaggcctgtttacgcactgagggcagaagcaacagggaggatcagttcatgacacaggagacacaaatcgccgttgtggtgttcacagacatgggttaggattggctgcatggatgacagagcactgtgggttctcccagagttgctggggaggaggcagagttggtgagcacaggcgagggtccaggatgcaggaatcctggagctcaagtcagttgttcccttgttgtaagatgtggccagtgttgtgagcttcacatctgtgccttgaaaaacaccacatctgtttgcagagttgtttactatgtatacacactcagtagaaacaaaaattggaaacagtcagtgcccaccatcaataagtaatggttgaacacactgtggtataagcttagactattttagcttgggctattttgcatgattaaaaatgttctggccaggtgtggtggctcatgcctgtaatcccagcactttgggaggccaaggcaggcagattgcttgagctcaggagtttgagaccagcctgggcaacatggtgaaaccctgtctctactagaaatacaaaaagtagctgggtgtggtggtgtgcgcctgtagtcctggctaactcaggaggctgaggtgggaggatcacttgagcccattcgtgcgccactgcactcctggggcacagagtgagactctgttagaaagagagagagagaaagaagagagagggagggaggaaggaaggaaggaaataaatggaagaaatggaagggaggaaggggagggaggaaggaagaaaggaagttcagccagttgccttgggagttctccattgcactgggttaagtgagaagagcagagacgtttatgatttttcaaaacaactaaaacaaaacctctgtgggtgagggggcaaggatatggctataggaacatggggcagattaagaaagggatatacacacaccacttagcatttgttacaactgttgtgggagggatggagtgcagaaaaagaaaaaaaaaagtgcacaccatcccatgtatgtgtatacaaagggacgcttggaagactggtccccaaaatgttggtaatgattgtgtcagggtgctgcagtgctagttgattttttttcacacttttgtatatttgagtcttttacagaaagcatttattatttatgtaataaaaatctaaatgacaagatttctgttatgggaaaaatgtagctatacagtgttgttgtaaaaatgtttgcttggttcaccactgaacttaaaatgcttttaaatgagggaaggtgacgatgagatgattatgatgatttgcccttgagttacatagctggtgtacaggaagctgtcgtttcttttggcttacgtagaaatgtttgtggtgtctaattccacagatgcacattgactctcatgaagcccttggagtgttaaatacattatttgagattttggccccttcctccctccgtccggtagacatgcttttacggagtatgttcgtcactccaaacacaatggtgagtctctcgcctggctcagcagatgaatctggacggcttgttcaggctctgattactgggaccacccccagaatgtctgagtcagtcagtttgggtagggcttcttgagagtttgcttttttttttttttttttttttggtgtgggggtggtgcggaacagagtctcactctgtcgcccaggctggagtacagtgtcatgatctcggctcactgcaagctctgccttccagcttcacaccattctcctgcctcagcctcccgagttgctgggactacaagcgcccaccaccacgcccggctaatttttttgtatttttagtagagatggggtttcaccgtgttagccaggatggtcttgatctcctgacctcgtgacccgcccatctcagcctcccaaagtgctgggattacaggcgtgagccaccgcacccggcctttttattttttttggagatggagccttgctctgtcacccaggctggagtacagtggcgctacctcgactcactgcaacctccgcctcccgggttcaagcaattttcctgcctcagcctcccgagtagctgggactacaggtgcgtgccactgtgcccggctaattttttgtatttttagtagagacggggtttcactgtgttagccaggatggtcgcgatctcctgaccttgtgatccgcccgcctcggcctcccaaagtgttgggattacaggtggctctcgcaccaagccaagagtttgcatttttagcaaattcccaggtgaaactaatgcctgcttttctgggagcacactttgggactcagtgatagagaggtttattggtaggatagtaaaataggagttattttctttcacaaaattggcaattgggggaaatttaatcttccttttttcttcagctgtgacttatgtattatgtttattttaggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtatgctttctatctgagcctataactaacccatgccttttgggaagtcacgtgatgtttcacagtcagtaagtctggaataatacctggtcttgcttcacttctgagttgggtaaagaagtctgtatcagtgtaattttctaatccgtcctgcattatctatggctcttggttcatacctgtcttgaagttctgtcatgttctgtctcttgtcctcagtagagatgctacagcagtggctcgcctcaggcagggcagggcagtggggtggctgtcctgggggcaggcagtaggggcacgctgacgtcagggaagttgaaacccaagagaagccagtaaaagtgagtctcagattgtcaccatgtgctggcagttttacacgctgtcagtaataaaagtcttctccctgcagggcagcctgcctccaataaatacgtgtagtatcaaatcctgtcttccctcataaattgtttggaagctccccaaggacagtgatgaggcactcgtaagtgcttgctgcctagatgggtccctctccacctttgctagattctgagcattcactgagttagagctgcttctgcaaatgtgctgcttctgctaagtggctgtgacttcatgcagccttcacttggtttgtcatcagtggagatgccctgtgttgtcgaaggagataagcccagtaagcctgctgggcaccttttggtttgcaggttcagcaggcagcccatggctttccctgtgtcgcattgaagcagctggctaaaattgatgatacattaaattcctgtgacagatgatcagcttgtatttgtgtaatggtgtacagttcacaaagcttaaaaaaatgctacctgccatttcatcctcagtgaggaaggtgatacacagagagaccaagtgactgtgtccacggcgacggcgctctgcatttcactttagcggttaatgtactctacctatatttttactttatatttaccatatatcttttcatgtatacttggcgtaagtgctttatagtagtcacctaattcactgtcatcttttttgtttcttggaaggtttctattacaactggttggtattcttttagaagacattgttacaaaacagctgaaggtggaaatgagtgagcagcaacatactttctattgccaggaactaggcacactgctaatgtgtctgatccacatcttcaagtctggtaggtgaatcacattagtcttcctggagtgtctcgttccccattctgcactatacactctcagagtgtaggagctgtgctgcccggtagaaactctgccttgcccagtgtgccagttgaaaatatttgttgctgtaagagtacacctgataccatgtgacccagcagttccactcttgggtatatacccaaaagaatggaaagcagggtggtgaaaagatatttgcatgccagcattcatagcagcattattcacgatagctaaaatgtggaaccaactgaagtgtccctcgatggatgaatggataagcaaaatctggtgtatatttacagtggaatattattcagccttaaaaaaaggacattctgacacatgctacaacatgggtgacccttaaggacattatgctaaatgaaataagccagtcacaaaaggacaaatactatgtgattccacttacatgagggacctggagtagttaattcatagatatagaaagtagaatggtggttgccaggggctgcaggggaggggagttatttttacaagatgaagagagttattctagaaatgaatggtggtgatggttgtataacattatgaatgtacttaatgctactgaactgtacagttaaaaatagttaagaggaccaggtgtcatggctcatgcctgaaatccaagcactttgagaggccaaggcaggaggattgcttgagccaaggagtttgagaccagcctcagcaacatggtaggaccccatctgtacaaacaaactagccggggatagtggtgtgcatgtggtcccagctactcaggagactgaggctggaggatcgcttgagcccaggaggttaagtctctagtgagatgtgttcatgccactgcactccagcctcggctatagagtaagaccctgcctcaaaaaaacaaaacaaaacaagacaagagccaaaaatggttaagatgggccaatcacagtggcttatgcctgtaatcccaacactttgggaggtcaaggtaaaaggatcacttgaagccaggagcttgggaccagcctgagcaacatatcgagacccctatctctacaaagaaaatcaaaaactagctagatatggtgggcacatgcctgtagtcccagctacttgggaggctgaggtgggaggatctcttgagctcaggagttcgaggctgcagggagctattattgcactccagcctgggctacagaatgataccctgcctcttattaaaaaaaaatccaaaaaaaaaaaaaagtaaacctgagagcttcctcctcctgtgttaaatttggaggccaagatgtttttgttacttttacaaatgatcaaggacggtgaaggttgggcatggtagctcacacctgaaatcccagcactttgggaggctgaggcggggtgatcgcttgagcttgagaccagcctggacaacatagcaagagaccccatctccacaaaaataaaaaaataaaaaaaaatagccaggagtagtggcatgagcctgagcccaggaggtcaagctgtagtgagccatgatcatgccactgcactccagcctgggcgagatcgagaccatgtctctagagaaagaaaatgacaaggacagtgaacccaagaaagtcataagatgccagctgtgcagcaagcatggaaagcagccagtccaaattaggacagtgtgttttccaagaagaacgatcgtttgtaatgagaatgctttgctttaaataaatgactaaatagctagaagcctagttctaggggataggcacgtctttcttctctcaagaaaatagaaaggcaattctaatttctagtaacagcaaacagcattaagtcatggtccaaatatgaggcaaaccaaaatgtggcttgattgttcagcagttgatctgttggaagcccttgatattaaaaaggttctcctttaagcggcttaggagtcacgatcaaagacctatagaaagagatgccatccttctaggatccttggctctcttgggaactagattcagatagtcataatgtaaatactgcttgagctttctttctttctttctttctttctttttttttttgagacagagtttcactcttgttgcccatcctggagtgcaatggtgccatctcggctcaccgcaacctctgcctcccaggttcaagcaattctcctgcctcagcctcccgagtagctgggattacgggcatgcaccaccacgcctggctaattttttgtatttttagtagagacagggtttctccatgttgaggctggtctcgaactcctgacctcaggtgatccacccgcctcggcctcccaaagtgctgggattacaggtgtgagccaccgcacccggcccgagctttcatttttgaaatcaatgtatgactgaaacactgaagacttactgacttaattatggtttcagaacagaatgaaaatgtcttcggttctgatgaatataaaaggaaaactaaccaagttaatttggcaagtagatggtagagatagaggtggggagtggaaggggaactaaaatcttcacctagcattgttgggattatatggttacatcatctgaagttgacagaccaaaatatagaggcttcagaggtctccaaatagaactaaacatgtaattcagattgttaggaggtagtataaatgagctaaatctcatctttattacggtagagttaatgggtgatgtctaaagttgtctgaagtctataaatcatgacaaattatgatgtggtgattgtattcaacagtctttcagttgcagggataaaaccccagtttaaactagagtaagagaaagaatgtgttggtttaagctcctggaaagtgcaggcaagggtagttggtaggactgcatctagtgttgtaattctgtggtctgcattgtatatttatgcatctcagctctgctttcttcttttcatttatataatttttaaattttattttaaagatagggtctcactttgtcgcctaggctgaagtgcagtggcatgaagtgcagtgcgaggctcactctagcctcgaactcctgggctctagagttcttcctgcctcagccttctaagtagctgagacaataggcatgtaccaacatgcctggataggttttaaaatttttttgtagaaatggaagtcttgctgtgttgcccaggcgggtctttaactcttagcttcaggcgatcctcctgcctctgcctcccaaaatgctgaggttataggtgtcacccaccacgcccagtctcatctctgcttcctgtgttagttttgttctctggtgggctgttttcacatgaccgaagatgacctctagcaggctgtgttctcagcccctcaagtaggcctatgtgattggccttgcatgagtaatatgggtgaccataaacccctgaatgctctggtccacatgggccaaatgggagactggacagcattccattgatgaggaggtggggctggtctccgggagtaagggagaggagcacatgcagtaactgatggtctgctgcaagggatagcagcacagcagttagaattttggaggtaactaccagaactgaaaacagaaatgataacaagtagttgccttaaaaagggatgggagcagggtgcttttgtgatcaaagctcctttctcttactggatttttgtacacattttgcatacatatcttagagtaaaagatagcattttcagccttggtccatttgaggatactcttggcgtggcccgcctccatgctagcaggctctggttgtgccaagttcagttgagcatcctggctcttgcctgcacggaacttccagtcagtgcgtcagtatcacaagtcttgatatttcctatgaagaagaacagtagtgcagtgacagacgaaatgggtgggcaggcagaggcaggatttctgagggagagaagtagctagctttttgcagagaagagttccggcacccaagagagcagctgagagtacaggcaggcaggcaggatgccggtagggcccggccgcacggcgccacagaatcctggagaaaggggcctcttcatggcctctgcattcagctgctgtcaccctccgcacaggccatggccaaaatttaattttcatagtggactctagtttttgagccttacttgctattattgaaataattttcttgtttctttttaaagatcttcggattatgcttcactgaccactgtaataagtttaaagttgagaaaatatggcttgttaatgaatgataggtcaattttagtatgttggtcattttaatattttgccaccagttggtttggatttgatgccaggaggagacagcctcatttctaaggactagtcttgcctttgtgggataagggtggtgtgttctgtgtccttctacatgtccgagcgatctctgtgcagctcaaatgtggtcactgtcttattgcgctgatttcctctccttccatctcacaattgaggcaaaatattgttactgttgaagtgttgtccaataggacttccagcagagacaggatgtctgcactgtctaatttagttgcctttagccacatgtggtgttctgtacctgaaatgtggctggtctgattggatagcttaatttataattttatttaattttaattaacttaaatttaaacagctctgtgtggatagtggctcctgtatgagacagtgcaggtctgttgagaagcagctttactggtgggagtggagggcttggagagggcacgtgggtttcctgctggtatcttttgaccttatttaatctgcccaacatttgcaagtaagttgtgtgtgtgtgtatatataaatgtgtgtttctgtcttcttgtttcctttgactgcatttatttgaaagacactaggtggcagaattactgtatttgattggtttcaagataagagttgaaataattcatctcgtgtttttatataagtaaggtgtgtttagcatgtaaaattggtaatatgtattcacgtactgcttaaacaaaggctatgaattccacccataaaccgaaaatgaagacctttaaatttgtccatttcaggcgtgggtacttcttaaataatacctggttcaggaactagtcagaatggcacccttgactttttgtttcctgcttttcctcttgttgggagaggagggtattcatcccaaagtggtttgcctatttcacattccatctaggataagcagaatagccaagaaagatagctgtcctcctgtttacaacatttggggtaaccagcatccctctcttttggtccaagatagactggtttagaaacagatgatggcaccagaggcccaggaggtggaaacatcagctttgtttgttgtccatgtggctgaattagagctgtctggccttgtagcctcaacacggccttccagctttgctcaccgtgattttcaaggacacatcttgtgctcttccctgcctgccatccagactatacccagtcagggtggcaggagctgctgccccttcctccctgagtcctggtcgtgggtggtggagatgtgccatgacgctcacggaggcatgctcaccccttcctctgtggcagaggggatggctgcacgacagctcttccctgtcctttccaaagcgtctgtggttccactttttggggcaaagcaggaatactggaagagagagaaagtggtcctttctatagtaataaagttgacattgattcaagttcatgcttggggaaaggacagggctactaacaattataatgctgggagcaatggaattttctcatgggtatgtggtaggtttaattttaattatcccagttaattcttagaactgctctgtgaagtatttcccgctttgtgcttaagttctaaaagatcctgtgccaaaaccaagaatgaaaacccaagcattctttcttgcccatcgatctttctctcatcaggccacttcttgggttgatagtggtgagtgtagccgctgccactttcagaatacccaccatgggccccagtcactgtgtggcgtggagaagagatggttctctctgtgtcatagctgaacaagcccagcccagagaggtttctgccctaggagctctcgatggtggaattgggatgcgatcccacatcctgcctgttttgaaaacagcattctttatttccaattcctgcttccattgttccttttaatatttctttgtttagctcacaaaaacacggcttgcggagctgctgcgtgcagctgtagctgtttctctgggtgcagcctgcatccgccttcctgcccgcctcctttcctgcactgccatcgtggtctccgggcacttggtccctttctcttcccctgagtccctttggctcccctgtgccacccttgtgatccacaggctctgccttctttctgtctcagactgctgctcatcactactcgggaccctaggaagggaggttccaccgagaagcatcttctcatctcagccacgttctcagtgccactgttgtctttgttaggtaatggtagctactgtaacaaataaaccaacatttccatggcttcacaccagagaaggttgtttcttggttttatgacaatgtattgagggtgttcttggttcacggatggttttcctccatgtgggaattcggggacccaggctcctttccttcttttggttctgttctccaggccttcacatcctctgtgtctggttggggacaaggagagggaaggtaaagaaggctttgtggccttggataagtgacaggcatgcctttgctggtgttctctcgtggtgacaggtcacagccccaccctgtaaaaggggactgagagacgtcgtcctgctgcttcccagcagcagcactgtggtctctgatgtgttttctgtgaggataaaaacaggtgattccaggatgaggaaagtcagggaaacccttggaaggaggggaccaggcgggtgtcaccatgggattagtggtggcttcagaatgagctgcagcgagtgccatgccttctaaagcttttgctattctgatatgcccacaccatgcccagcaggtgtctgccttgctctccgcagagagagtgatgaatccttctcatgagcctctgtccagttgttcctccctccacctggaagggaccctgggttcctcataacatcccagcggaacaggggaccttctatcctgtccccaagttcatcctcatcctcctgccggcttcctggcccctcttatgtctgcttcctgacgccacatccttctggattctctggaattgaattttgcctttgatgcttatttaaaaatatccattgcaggccaggtgtggtggctcacacctgtaatcctgtgcactttgggaagccaaggtgggcagattgcttgagcccaggagtttgagattagcctgagcaacatgttgaaatcctgtttctatagaaaatacaaaaattagctgggcatggtggcgcacacctatactcccagctactcaggaacctgagacaggaggatcaattgagccccggaggccaaagctacagtgggctgtgatcgtgccactgtactccagtctggtcaaacagagtgagaccctgtctgaaaaaaaaaaaaaaatccattgcatacttcaccgtagcgaaacatgtatgtcttacctttcctttcctgcctgtagctgctcttttacacttaacagccacactaagccagccttaaatgaaaaacaaaccagcacttcctgtgccctcctgcttccttcatgaggggtccctccctctgtgtacactccattctcattgcccatggtggtttgtttccctcttgtttctcaagccatggcagcctgcctcttgccctctttactaaaaaggcctttgcagaggctgcctgtgttctttctttctaggtctctctcatcctaggccctccagcttgattctgtggagctgccctcttgtcactcagtagcttgtggggtcttctctgtctagccacttaattgattgtgttcctcgagttgctgtccatggtctctcgttactgttttctctgtgtttctgcctctctccttggccttggtaggtccatcccctttgtgaccttggctgttgctctcatggacaactttctcttgctggtccttgtagtcctggcatccagcttctcgacacgggacttgtcctgccagtacctcagacttgcacttaaaattgaactagcaccactgtcactctccagggcctcttcttgttaattagatcattagggatgttcagaatcccagcatcatagtatgttcctcctcccgctaccccaggaaccctaaccttacctcctcctctctatctactaggaggtggccctcagagtccgtctcatcttccacctgaacttccctaataggctccagcagctgccaccccgggggctgagtacttcctccatgccttgtgcagtgctgagccctttacctgggttctcctgtttgctccttattacagccctgcgaacagatactgctcttaattccatcttacacctaaggaagctgaggccccaggtaaggtgcatccaaggtcacccaggtagtagacagtagagccacgatctgaaccaggcagtctgattcagagcctgtgttgacactcagccacctagaacacagcttggattgtgggtttctattacctgttcaaaacccctacatcccgggtctgtccctgcacgtgctctgtggcctggctgcatcttccttgaaggcagtgcatgcctcttcactcagggggcccatgcaggaacagagggccccacagaaggatgaggccagtgcagaatgggctggaggggacaatgctgaccaggaagcaagtgtagagaaatcccaggaaacctggaggagccagagacaaggcattagaactcctcgtcgtgacctggtctgcattctctgagtgtgctgcttctgttagctcgcttccttggtctcaggttatagtttaaggcattgtggagccctaaaaagcctgtactctgtttttacctgttttaggaccctttcactttggggatgtgttgattttttttttttttttttttttttttttgagatagagtctcgctccattgcccaggctagagtgcagtggcacgatcttggccactgctgcccctgcctcctgggttcaagcaattcttgtgctcccgcctcccaaatacctgggattacaggcacccgccaccacactcggccaatttttgtatttttagtggagacagggttttaccatgttggtcaggctggtctcgaactcctgacctcaagtgatctgcccaccttggcctcccaaagtgctgtgattataggcgtgagccaccacacccggcctgaaatttaaatcagaaataaaattttgatcccaacagtgatgccaggcagcccagatctgggggagagggtggccttggccagctgggcctttctctgtttcccaagtcttgctgcctctccctgctgggctttgcagcctgtgcatgtctctgtgcctttgaccttgtttatccaaaggagaggatagaatgaagtcatgattcctggagccctgagaaggatgctgtggagaaatttgccggtagaatctagctgagtgtgttgctgaggtgccagcattgtgtgtggggaggctgaccgcttggcctgcctaggcccaggatgctccatggccgggcacagaggccacttggctgtcaggtgtcaggagcctgcagagggcacacagagcctggaccgcaggggggtcctgctttctcacctggcctccttcagcatttctgtccctcagtccttagcaagcccaggagctgttgagtttggcaggtgccgagtgctgttcctgcctgtgtagctgtggctcagtcctgtgggggccccgctgtggcccgagtgcagtgattcgaggcgctgagtgttccctgactccttctccaggagctgtgttcagactttcgcagctcttggcttggagctcctggagggcttggcattgccgaccaatgtggaggtcgacagtgagagaggaggaatgctagctttcttgaccagtccattaaataagtgggatattggccaggcacggcggctcacgccttaatcccagcactttgggaggctgaggcgggtggatcacgagctcaggagttcaagaccagcctggccaacatggtgaaaccccctctatactaaaaatacaaatattagctgggcgtggtggcaggcgcctgtaatcctagctacttgggaggctgaggcaggagaacagcttgaaaccggaaggtggagtttgcagtgagccaagattgcgccactgcactccaacctgggcaacaagagcaaaactctatctcaaaaaaaaaaaaaaaagtaggatatctgtttctgcttagaaaaatcagaattttctaaatgccaggtgttctgaatacgtaagtatgggagacgactcagcctgtttcatttttatgtaaaatcttcgcgtagccatgtggcactggaccgagatgaaagcaaagacatttctccttaactttgtttctaggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaagtaggttcataatgccccacagcccagggcgccagcccagcaccctgtcctgagactcccagtaacctgagctttggccaccgttaaagcattttcattttccattttttgtgagggcttgtgaaatttctgctgcatattaatattcctttcatggacagcatattattgggacaaacatgcggtccagctaaaggcattcaaaatagcagttgctttctaaatgcgattttctttggcaggttctttgacaccattgcatcttgtgggatatgcttgtcatgctctgtggctcctactaagttctagtccttaaattggttccatagccagacatgttgcaatgtcttaacctcattataaagtaaatgtggttctggttatccttagataatgaagtaacagtgtagcaaatttcaaaacctcttggaaatgttattttaccattcaaaaaggcttactaaggttctcgttatgggtggccctctttttgcaaaaggttttcaggcttaagctccatttctaggtgctccaacactccattatttgtatatgtatggaaataaaagctgtgaccacccccaaccctggcccccgcccagctgaatcctcagcacagtatttctggaaggctcaagatcccacgctggggaaaagaagttctggagacaaaagagggcaggtgctgccgtgcctctctgctcagtatggatactggaccttgtgctgccagggctcccagtagggccagttcatggcactcagctggaaagtccactgttgggaggcattcttaaccatccactctgtgccgtatgtagtggggtctggtcattctgttggaggagacagaccagtgacgacatttgaaatgcttggtggatgtcttaggcctgttacgatgactgagcactgtgggggcaggagacagaaagtcagtgtctcctagttctgtgctgctttaacgtgcatagaaatcagctgcggattcagcagatcactccttttctgacagatgggcctgcttactctgatgttatatcagaaagctctgaatctgggaattgtgtcccctgaattggagtaacagaaatgcttagatgatgagtgtttaaaagaaataaaccaaaggtaaatttagtttggaattcagcaagcgtcttcattcagccctctgagggcaaactacagctttttgtaaatgtaggtaaattctgtgactgtttcgtgaccccctctgatccagttttcctttataaccttctgtattgttccttctattatcctgaaataacattaatagattaggctgggcgtggtggctcatgcctataatcccagcaccttgggaagccaaggcgggcagatcacctgaggccaggacttcgagaccagcctggccaacatgatgaaatgctgtctctactgaaaataacaaaaattagccgagcatggtgacaggtgcctgtagtccctgctactcagaaggctgaggcgggagaatcgcttgaacctaggaggaaaaggttgcagtgagctgagatcgcgccactgcactctagcctgggtgacagagtgagactccatctcaaaaaaaaaaaaaaaaaaaaaaaattaatggatcaatggatttttaacctaataattaaatttcaaaaaatatcgttctttaatggtaatgtaaaggtaaaattaagataatatgtaacaagcatgtgagtgtctaaggtgtccccgtggtggaaggaaaaaataaatccccataagtgtccaagatgcccatagagagcagagctgttctggtttaaacccctgctcttagcactgtgtttttccagctgtgggtggtgggggatgagtatctttttatttccatgagatgagaaaaatgaattactagaagtgtgaaatacaaaacacagctgctctttttttagccatagactcagcagccataaaattgctgtatccagttgcagaaattcctgctgcttactcttgaccctctctcggtttgtgtgcatctcctctcaggctggctcccagatgggagctggctccaggcgacactgggtgctctgctccaggaggtccttatgtgggtcctgccctagcctagcccctctcttatggactctgtcactgtgggtttatgattcactctcaatctgtcttacctcttggtgaactgttagagtcctgcctatactttggcgcttgtgggtgtgttgtggtacacatgatgtgttggtcacttcccagctcatcttgttctgagtcaccctagatttgggacattcattcgccaccagtaccgggcggtgtatggcctgagatttgggggggcttgtgctgctacaaattggggctgaatttgagttgacagtggaccttctttatgtctactgctcatatttgaattgcaaatactgcctcttctctttcagaggctcattaccctatagctgtattattgcaaagtgcacaattacagcttgagtgtaagtcacactgcgctggcaggacggcccactgagaaagggcacgtttcctgttcgttagttttcacattgacacataatttacaatacagtaaaatgtacttttctatcaactgtagtcagtaacagcccccctcccccaaccacatcaagatatagaggagtgctgtcacttcaaacagttccctcttcctctgccacatcctgcccctccccaggtctaaccaccaatccgtgctctgtccctctgttcagcccattgcagaaggccatagaaatagaatctataggctaggtgtggtggctcatgcctgtaatcccagtattttgagaggctgaagtgggaggatgacttgaggctgggagttcaagactagcctgggctgcctagcaagaccccatctccagaaaaaaaaaatttaaaaattacaatcacgtccctgtagttcagctgcttgggaggctgaggcaggaggatcacttgagctcaggagttagaggttacagtgagctatgatcgtgccactgtgctccagcctaggtgacacagcaagacgttgtctctggggaaaaaagaaagaaacggaaccacgcggtgtgcagccttctgagtctggcccctttcggtgagcagtgtctaaagttctgtcgcgtgttgcccacgcgtcggtggctcgctccttgcaactgctgagcattgtatggctaggctgtagtttgttttcacttcaccagttgggaaacagagaaaaggcactttttaaaaagtttaaatctgtagaattttggtttttaccagttctcttctaaatcctgagggattacaggaaaagttgttgtatttcagaatattcttagcttgatgtgacctctgtccccgttaaggccctttgccgcaatgggaaggacgtcgctcggtcagaccctgaaggtcagaggggcagtttgggagtgtgtcaacattttaactgtatggactagagccaagagtctcaaggtttataattcccacgtattcaaaaagaaaaaaacaataaagtgagaagtcagtgtagagtgaaataacctgtgttagtggggaagaagtgtttttaaacaggatttccataacgtataacatcaacatgtttagagtggtgatgtttcattgggaaacgaacagtaaaacatgaaagcagggaggttttcattctggcagttggcaactttcacggcagatggagaatttcaaaagcaattgctcaattatcaaacatagccagtgtgagttctgaaataaaggtgctgattgaatgtgcagctttatggtggattttgctattcaggcaagcattttaattttctgcctgttaaattctgttttctttagtttttcatatgtggtttattgtagcttaggaatagataactgagagtatatattacacatacaacattctgatatggcaatatttaaaacaacttgtctgttttagaactagaattaaacataatcatcttcagtattttgcaaataagctcactgccatccagaaacattgtcaatgcatctgttgctccttctagaagacacagtctgtccagcacaaagttacttagtccccagatgtctggagaagaggaggattctgacttggcagccaaacttggaatgtgcaatagagaaatagtacgaagaggggctctcattctcttctgtgattatgtcgtaagtttgaaatgcctgtaaacggggttgagggaggtggggaccaggagaacatcctgtgtagatgacacttgcatggaccctctggaacccagaccgcccggtgtcctgccaagctccatcgaaactaaatctagaatgaatgtttacttctgctgtgacatataattggagaccaggcctggccttccagtcactggattctaagttggactgtgagagtttttgcagctgactcatttatcaaatgcccggctattggctcacgcctacatgatgctgggtatgtttgttaatttgagggaagcaatggaataataataactaatgatttaaaaaacaaagtaagtgcattgactgtagtggggttctgattttaaatttttttaaaaattaataccaggagcagtggcttatgcctaaattccagcaactcgagaggctgaggtaggaagatcacttgagcccaggagtttgagacaagcctgggctatggtgtgagacacccatctctaaaaaaataaaaaataaaaaattatccaagtgtggtggctcgtgcctgtaatcacagctctttgagaagctgagggcggaggatggcttgagcctgggagttcgagaccagcctggcaacacagagaaaccctgcctctaccaaaaaaagaaagagaggaagaaagaaaaattagcctggcgtggtggtgcatgcctgtggtcccagccacctgagagactgagaagggaggattgcttgagcccagaagtttgaggctgcagtgagctgtgactgtgtcactgcactccggcctgggtgacaaggcgagacccctgctctaaaataatttttttaagttaatttgtagaaaaggtgttagatgttctttgtcacattttatgatggattcctgtttaaatgccgttctctttaaagaaaaaaaaataacttgtgggagtttttaaccataaaactagcatcacatatttaccatggagaatttacaaaaaaacaaataaacggaggaaaataaaacctcctgtaatcatactactcagagataacttgctgttagattttggtctagatttaatactttttctatatttatattaaaaatatttaaaacatatgcatttctttgtcacaaacatggtatcttatagatactactgtcacatagcaaaacagtgttaaatattctgaatcagaaaaggaagccgactctccaactgaaagaggtgttatcctagagactttttctggtgatgacaatttattaatagtcactttttgctttactttctctattgaagtagtttttctattttgttctacttttaaggataatataatttataatgctgtttttcacagaaatataagaaaaaagatactaattttataagttaataaagtttgatcatcccaaatccaaaaatctgaaatccaaaatgctccaaattctgaagctttttgagtgctgacattatgttcaaaggaaatgttcattggaaggtttcagattttcggatttagggagctcaacaaataagtataatgcacatatttcaaaacctgaaaaaaatcctaaattcagaatacttctgatcccaaacatttcagataagggttattcaacctgtactgtcagatgatcccaaatgaaaaatattaatcgttaaccaaatatcaaggaattgatcacattttacagtttctgcctaggattatgaatcaagatgaaaaggctctgcatgtttaaaaatatatatttttattttcttataaatcttaaatatctacacttaagatttatttgatatgtgggatccattcatattttggattcaacagttctgtcaaaactgtggcagtgataggggattctttttttcccactgaactatcacaaaattggaaaaagagtaattggagaaccccactggcttagccggcccgaagcccgggagagggcaggcagtgctgtggatggggtcatcccagcgcaacgctgcccctgctacctgcggatctcgctgaggcctgcctttgtcctttgacccttggccatttgttagtgtctctgagagctggactgctgtaccctacttccccagggggcctaacttcacacagcctctgccgcagtgcgtggttggaggtgacggccttggtaaatcgagtttcctacctcctcaattatttgtgctcatacactgtatatttttagtgaggtttatatttgggatgtgttttctccttcttaccctttctggcctttctatggcattaatacctggtctcttcttgtgtacttgaaaatgaatctctcatcatatttttccttagtgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactgtacgtcttcatcctgccgactattgccagttgcagttttccctgccttaaaaatggagtattgaaatttttaactttaatttctgatttgcaaaatagtcatcttttgttcttttccttcttgctgttagccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacaggtattgggaagagaaaccctgatattgatttatattgaaaatttagcaggccaagcaaaacaggtggctggctttttcctccgtaagtatggtcttgacatggtcaccgatagaaacatggaaacatctgcaaacttgccgttactcgtgtgtccgatctgactgtttcttgtatttttttctagtctgcccttactaggatgaactgtacacatcagttcatcctttttaaatgagcatgaggttattttgggttgttaggtgttacaaacacactaatgtgtttttgtctattagagcagcatggcccagttgccaatggaagaactcaacagaatccaggaataccttcagagcagcgggctcgctcagaggtaatgctggaaacacaggtcgtccttgtgttaggacaacccaggatataaaggatatagatttgtacgggaataaattcacaggacaagaaatcgatgtgccttataggtgggtttactgcagaagtgccataatagaaccttcctacttttaaaacaaccagatctcactttctaaagagtaaaggatgaccggcaggatcacgtctgtgacgtgagtggaggcagtttgcactcctggtggctgtttgagaggtagcatttagaatgcctgtattcactgtcctgtgatgagtgggaaaataggttatcaggtttatcttagcaaaatcaaagcatgtcatctaattgctaaacaagagttggcaaatctgagagacattactcaatccttggcatgcaggacttacatctgcatcctgttgccattttatgtcttcaaagcatttaatcatttagttgtgtttgcaaagtctttgagaagcctttgtcagaaatccctacatctcctatgtgagtgtatttccatgactgcagaataagttaaacttttacctttttccttcccttgcggggcggggtggggggcagggattgtgtgtgtgagagggagagagagacagcagagaaggagaatataattatcatgctgtgtactttgagctgaaactgcaaaaaaggaaaaacacacaaaaattattatgcttttcagtctttagagtaccttgtctattatgcttttcagtctttagagtaccttgttgatggtgtttttaaatgggattgggcacaattaggtggacagtttgggatgatttttcagtctgtagggccaagctcttttgtaatttgcattatgaagttgtcactctcatagcagatggcgggagataaactattattactttttgaccctagacttagtcttcagtccagatgagggagattaaaagattataaatatcttgtgccagatgaggtgattttattttgaaatgaccatgaattcctatcagttgtcttactgggatatttgatagtggaatttgtgcatttgagtcttagatgatctgttttacatttattaagaaagcctttattagcttttatactgtgtattgcctgttgcagtgtttgagtataaatgaaatttctggaaaatattaatggagtacaaactgtgatacttaaaagtaaactagggcctgcatttgtatcatgacctgtttgagtattgatgagaagatagctgtgaagaaaaaggtttaaacaagtgtattttcctttaagaagccactaatagtgcatctccttagagtgtatatttctagaatcctagtgtgcagagtttagactaagactaaaaaaaaaaaaaaacaaattatactgtaatttcatttttatttgtattttagacaccaaaggctctattccctgctggacaggtttcgtctctccaccatgcaagactcacttagtccctctcctccagtctcttcccacccgctggacggggatgggcacgtgtcactggaaacagtgagtccggacaaagtaagtgtccagcgtgtctgcatgggaggcacagggcgctgagtgcctctgtcacctgtggcagatacagagagtgcagaggaggtgccgtggacccaaggagttctggcgctcggctcggctcagtgaagctgtggttagagacgtggggggccatcaaggtctgagggagccaagcagtgctgatgtgggacccttttggtaggagtgtggggtgagtagttagtgggtgaatcaaggaatagtcggccgtggcctgcaggcccctgactgcacaggccttcaagcacatgtcaatgccgttagcctccctccatctcctcataccttctggccacctgtgagttgcactgccactgccagccattctggtatgttgtcagcacctccactgctcatacctcatggttagggaccacctggagccttggtagagccttggtagagccttggtactctactttcctggacaaagttcagcttatgaatatgaatttagatttcaaaaaccagcagcccaagtataagaaagcgaaggttcagtcctgccttcttaggctctattcgctaagcacctgccctgccctggttgctggggagagatgagtaaagcagacaacccaggagaggatggcaaaggggccgctaacccttagtggtttagctatatttggaaggcctattggaagttcaccaggtgaagggggaggctgtgagggtgcccaggcaggtaacagaagtccaaaggggaaaacctgtggtgtggtgagccgtatagccacagcctgccggccggcagccctctcagcctagtgcggtgttcccaagcactggcctaggcctgtagctccagggatgtgaagtccccttgaacgccgcccatcatgttccccttatccatttttttcttcccaggactggtacgttcatcttgtcaaatcccagtgttggaccaggtcagattctgcactgctggaaggtgcagagctggtgaatcggattcctgctgaagatatgaatgccttcatgatgaactcggtacggggggagcagtggaggcaaggaatcctcagcttttcttgtgacttccaagtgggatttgtctcatcatcatgtgacccacttgttgacaacacatgttggggactccagtctgggcagggacgggatgtcggagagactccactctgaatggggccgggaagtggggaggactccatttcagatggggtcgggacatgggggttatgctgatcgagacagaaaagcacattgtttcagccacattagaatccacggaggtgttgttttgaaatccagctggccccaaggctgggtgtatggtttgggatgagaactatctggcctccactggaggaacaaacacaggatgttatcatctaagctccatggccaagacagaatggaagtcaaggttgcgtatttgccgtagacttcaacacagtgtcgtaatgcgtgacgtcaataacttgtttctagtgtcttggaagttgatctttagtcgtaaaagagacccttggatgcagcgagatttcctctactcacacctctgttagatgtagtgaggttcttcaccccccaaccccagatgtcagagggcaccctgcgcagagctaggaggccatgcaaagccttggtgtccctgtccctcacccgtgggcaggtcctgtgagcagtgggggggccacctcttgggtatggtgcagccatggcccaagcagggcttcttctcagacctactaggacgggagaaacctcctggtgctttagccctgcgttgatatgcagcaaatgggagggaagtgggcacctgggaggacaaatgcctgtagaggccgggagtgacggcaggtgttcatgaaaagagaccttgtggggagggcaacacaacagtgtgttctgatgtactgaagagctcaactgaaaacaacaggagaattagcccaaaatccatttactaaaattgtttatctttttttttttttttgagacaaagtctcgctgttgtcccccaggctggagtgcaatggcgctatcttggctcactgcaacctccgcctcctgggttcatacgattctcctgcctcagcctcccaaatagctggtattaacaggcatgcaccaccacgcccggctaatttttgtatttttagtagagacgggatttcaccatgttggccaggctggtctcaaactcctgacctcaggtgatccgcccacctcggcctcccaaagtgctgggattataggcctgagccaccacgcccggcctaaaattgtttatcttaagattcatgcagtgaaagctaacttactgagtgataaatttgcttagtgatctgtttattaggttttccaaatttgctaattgggctttgaacagctgtaaaagttctgactgtaaaagaaagcttcaacttttggcattcatgatgcttttctgagtattaaactaagatagatgttttacctgaaggatcggccaccaatctttaaatggctaaacaaaagggttgctaaaacataatccaaattgacataagaaataccatttttccaaccaaaattttggcattcatatggctacttttacgtatttcagctgcatttgaacatctttttcaaactttagggtggttggtgtatcactgaggtcttggatgacactttagctttgattttgtttttatgaattaaaattgtcataccaaaatttttatttcaagcaaatccaagagcataaaaaattaaaatattacttaaaatactaagagagaacagatatatattttactaagcatatgttgaatgaaattgttcaaatatttataacaggcatagagtagaattttcttaaaaatatttttgatggtataccaatttgtattttctcagaaacatttgccttattcttttttctgttgtgtttttcttacctgattgaaagctcataatctgttgttattgtttgttaacctttaatgctctgatttcaggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggtaattaaaattaaaatttatcttatttttaaaaagcattccagggccagtatagtactttgcaccaagtaaatgtacaataaaggcagtggatctaatacattgaaagcgtttacagaggtagctaaagagcagcacgggtgtcctcggctcagaatttcttcctgtgtgtttgccactttgccattcattgacatggtcatggacatagggctctaagcccttgaggaaggctgggccagacctcaggggagatgcagccccaaaccacgtgcagtcctgtggacggatgtgtagatgtgccactgaggaacaatgtcttgagctttcatcagattctcagagaattgcttgactgcctttcgaagttgatgcatctgtgctcacgtttgcacccacccacgaggtccttctgtttcaggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggtaagaggcagctcgggagctcagtgttgctgtggggagggggcatggggctgacactgaagagggtaaagcagttttatttgaaaagcaagatctctgaccagtccagtcacttttccatctcagcctggcagtaagtcttgtcaccgtcaagttattgtagccatccttcaccctcacctcgccactcctcatggtggcctgtgaggtcagccaggtccccttctcatctgcacctaccatgttaggtggatcctaattttagagacatgaaaaataatcatctggaagtactttatgtcttaagttggcctggacatgtcagccaaggaatacttacttggtttgtgttagtgcttgtaattcgcccccagaatgtgtacacgttctggatgcattaaagtctggcctgtatccttaaagggccatcgctgtgctgcctgccctcagcaaggacacactttgcagacccacagaggctccgcctccacctcacaccaaagaaagggaggagtccaaagggcatcagtgccattactcacaaaatgataaatacacccttattctgaaccacgtggagtcatatggtttgtgatccctgtccttcaggtttcagcttagtggggaagtgggaaagtcagcgtgtgatcacagcacagggtgattgctgctgattatattatgtgcctgctgtatgcaggatgaaatactttatatgcgtcatcttatttgactctcacaaccccctgtgagataggctctgttactcccatttgacaggtgaggaaagcaaggcttagagaatttcagtgacttgcccaggtcctctgagctaggaagtagccattctggcatttgaacccaaggcctgctatccctagaacccacgctctcaaattcaacctatgacagaggcaagccctggtgctgtgggagccccaaggaagagcctctggcctggtggccacgtagcccaggagagatttctacaggagcccacagcgctgaaggagagagaggcagcagagtaagggggctttgtggcagagaggggactggcactttggggaataggtgggtcaggactgaatgtaatggagccatgtcagagctgtccttctggaagggcaagggcacctggacgcgctgcccctcagtgctttggacggttccacaactgtgattcacacggcttccccaaacgaaggtacacgagtgggcattctgtgactcggtacttccctttaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccggtgagtccccgtccatgaacggtgggttcctatcatagttcctgtctgcttcaccatgtttttattttgtgctgcctgtttgccaggtactaagctaggaattggggatggagaggtagataaaatatgcatcaggaagggctgggccccatctcttactctccaatatattggagtctacactggaatttaactggaatttgcttttttagtcattttatttagattttgaagtttcagctttcatcaaaaatacctctaaactttatgtctctgtgatctttggtcttagctgttttatgtatttagtcttatatgatcataagattaataacattacattcagaagattatttgttttctgtcagagttaaaatgtttgtttttatactgcattgtaatattaacgtactgtaaaataaaagtggcttgttcttttcaaggaacagtatcctcaacaagggtcattagccacaatttttaaaaaattggacgtcatagtttacatgttagagggcgttttgaagctttgtatttttaaattaaatgttatagagtgatgttttcatgtttcataattgttttcatctgtgcatttgtagccaacttgaaaacaaagatccagggattactacttaaaagccagacttcttggaggttatagtgatgattttgatagtatcttgagccgtctcataataacctcagggtgagagatggccaacaggagacagtcgagggacttagaaatctgaatgaaatctgaagttcaaatcttcagacatataccactaaccaagagattggtacctcagtctagtattgtctgtttgtctaaaattggttctaaggaatctaggctagtctgtctatccctttcaacttttgtgaggctgcacaaatgtaaaatgttgaataaaaagcactgatggaagtgtgtagaaattcttctctttgttctgttgtaattttagttgcagtgcagcctggagagcagcttcttagtccagaaagaaggacaaataccccaaaagccatcagcgaggaggaggaggaagtagatccaaacacacagagtaagtctcaggacccatttttttcttacatgttgttcctccaggacttaaaaatcattcacagagacgtgcaccgcggtgagtgtggactcctggaagcgcaccgtagctccgctgtgtcctgctgctcctccctagctgtcagggaggctgtagtccattgctttgccagctcttttgtttccgagtgaacaccttatccgtacacatgcggctgtctctgaccctacagaccagctgggatgccactgggggagcgctcccttccccccgcacttcccacactctgcagttattctgagatccttgagggcagggaacaggtttgtcttctttgtgttctcagaaattaatgctcggcctctggtcagcaagcaacaaccttttgttgagtgataatgaataaataaatgtttcccacatgagtattcagtaacctcagtgtcaggttcagccatctgttttggtggatatttaaaagaaaattccgcttttcctacagaaaaaaaaaaaaatccaaatcccagtgatttaagccagttatagacttagacatatactacggcttttcatgcactttcctcccaattctagagtaggtattttactaggaaaatggtggcagtgcctgttgggaggaagattctttggccaagtgtcttttgttcttgccagggcccctaggctgctggggtgcttcagcttctttagcccagtgtctggtggggaatggcccctgttgcctgtcccacagaggtgggggtgcctcacctggagcctgtccacacattttacacagcacgcttacctggagcatcaggcatcttttccatgctctgtggctcaggaaacacgccttttcaatcatgagtgcaccagtgcttttgggctttttctccccgcttttgtgcaatcctggttgtggatggagttttcctgtctttagtcttctgcatagtacttttctcttctggttcccggttcaaggttttgtaattagagaatgacccagaagcaatggcattttaatgcacagccaaggacttctctgaatttgtatctcaaacctctgtgggtccttcaggcttcagtttgtgatttcatgatttcttgttgctacctaaggaatatgaaaacacccacctccctactctgcatcttccagccgagtggcacctcaggctgtggatcctgtgcttctgtggtgaggataagaatagtgccaaccgtgtggattgaaatcaatcagttaatccctccatgtaaagcacctggaacggatgacagtcttgttatgaatactcaacaaatgctatcatgatttttagttagatttccattgctttaaaacagttgagacatcttggcggtttgagttagagcaacgggccctgaagtgggttctgtttgggtgaagatgattatgcttattccccatggccctctttaggcaagagtgggaagctttctttgtttttttaatcacctcgataggacgttacttcttaaaggtcatccaataaatattaataggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcaagactccgtctcaaaaaaaaaaaaaaatattaataaagccaactcgttagcgtggggcttaattgcttaagtccaatgagaagtccttctctatcctaggaagttgcccaaactgtagaatctcgtggcctgtgggtaatagccacgtaatacacactcactgcctcaacaaatcatattttagtaggtatgatattctagactcaagacaccattctgtggatcttcccaagggtgtgaagtgtccacagcgtctgccttgggagtttccatgcccaccagaaccatgccccaagcccctcaagcactctgacctaggaaagccagtgaagcaaggatgacaacatggccctttgatactagctgagggacagacacaggtcctgggagaccagagaaagacgaggggcagaggaggtgtcctaaaggaagtctgaggctgaggagccacaggatggcttccagctgtcacaggctgctgctggccttatcacagagagtgggccagagggctgggaaccaaggccagagctcaggttcaggaccattccagcaatcccagcagaaaatggggagaattgtatggtataggcggatatgaaggtagaatctgcaggccttcagtggccaactcagagtctaagtggattccacagttacagcttgagcagctggttgtaggtcatgctttctacactgggcatataggatgtgttttttaaaaagtcctctcttaaccgttgcttgtttagatcctaagtatatcactgcagcctgtgagatggtggcagaaatggtggagtctctgcagtcggtgttggccttgggtcataaaaggaatagcggcgtgccggcgtttctcacgccattgctaaggaacatcatcatcagcctggcccgcctgccccttgtcaacagctacacacgtgtgcccccactggtgagtctgctcgttccttgcagaagaccaagtacggtgaaaggcaccggtaggccctgggctgggcacacgtgagagggcgggacagaatccccgcagcccagaggctgcctgctgtggttctggtgcccactgtggttctggtgccaggctgctttcctcaggcaccacgtgtggaggtcgctagtagaaatactgggttttctaaaatgaactgaggccctacatccctaagagattagtgttagacctgattctagagcaactagaccactttgcttaatagcagaccagaaaccacaccccctcgagtgagtgagattttcctttggagataattcatgtttttctacacagttttgcagttgtcttcagaattggtttaaagtaggtgttattgccaggcgcagtagctcatgcctgtaatcccagcactttgggaagccaaggtgggcggatcacttgaggtcaggatttcgagaccagcctggccaacatggtgaaaccccatctctactaaaaatataaaaattagccaggtgtggtggtgtacgcctgtaatcccagctactcaggagactgagacaggagaatcgcttgaacccaggaggcgaaggttgcagtaagccgagatcgcgccactgcactctagcctgggcaacagagcaagactccgtctcaaaaaaaaaaaaggtaggtgttattgatcagaacccttgtttcagataacatgaggagcttagcttgaggagagtgagggttgatggagggggactgacttctgcccagtgaaatggcatcatctcccaccagcccgctgaaataagatgatggggcctgttccttagggcctgcagcatcctcaggcaggaaagaaaggccgacctggcagggtgtgagccagcaggtgtaggtcagggagaatggagccaggtcccagggaagaggcttgtggctgcctgagaagggtgcgtgcctgcctgtgtgtgtgtgtgcacgtgtgtgtatgtatgctggagagtctagggaggcttgctccaaggacgcagtattgtttgatcctgagagataaggattctgccgcagggaatgaaggtattccagatggcgggcttattccgaagaagaggccagtgcctggcggtgctggaagcagttgcagaacagggagttgtaggctttcctgggaagagagcagcaggggtgctggagaagcaggccacacttgctgcatggggttgctctcggccccactcttggtgcacagcgagtcactgtgggttcattagcatctggttatgagacagtaactgctcctttggaggggctcgtggagaccatgcaggagggcacggtcttgaggtcatgccgtccagagcacacctgaggataggccaggacgggctgcacgctgtaggtaaaattcctccagcaagctcttcactggcattgaggagttccctgagtgcggtcatctggaaggcagctgtaacaggcactgcagtctctccctgggtgggtaccagagaggagcataggggagcataaccgatttaaagagagggctttcctgtggtgaggtaagagattagctggtcattatcatagagccccctctgcctttgtgcagatgggctgtgggaatcctggggttccgttgggtcctttgtcacctcactgaaggcatgtaagctgagctggccagaccgtgagctgatcctgccacttgaacagcatcaagcctgcctctggattcttctgtgcatggcacttgtctgagcacctcacgcacagagaactggacttcagagtttacagaaataagctgtatggttcattttcatgcctgcttgccaataaacatatctgagctgaacctcattgaacgcctgcctttattctagcacagcacctgctgtttgtgggcgaggggtgctgtctctaactcctgcctgcttctcccagcactccctgagtggggtgtgccagcagcctcaggatgaggacaggaagtgggagggcagagcagatttgggagggccacttgatggggaaggaagtcccaggaagcagttggagctgttttctgggggagaaggtgccagctctgggacagtgttggggtagtgaggagggagcccagtggagagaagtcgggcttcctgcttcctcacagtatgtctgtcctgactcaactcggatgatgtcacttccttttcatcttctcaggtgtggaagcttggatggtcacccaaaccgggaggggattttggcacagcattccctgagatccccgtggagttcctccaggaaaaggaagtctttaaggagttcatctaccgcatcaacacactaggtactcttggggcctctccttcaggtcaccattgtcggacatctaccgggaggaaatccagagcccccagtactgggatcttctcatttgactccagaaaagatttaagcatgataataatacaaacctatgtgaatacattttgcagtgttggcaaaactccttttatactgagaaaatagatcccagttcctgtgttttgtggcttgaatcccagctttgtgtattccgggcttgtttgaagtcaggaaaggttcatgtgtagtggacaacgtgagaccaaattctgccttagattttgcatttaggctaaacagtggcagcacttgtctcagaatgttttcttgtgttcaccagtctgatcctgttgtgtctcagtggtccattttctcatatgggaacaagcagacgggagcagatggagtcaggtttcttggcactcgccttccccagagcctagaggcagcatggggagaaagcaggcttggggctcagacagtcctggtctgcttccagccctcctacctgagcagcgcagggcaagtccgtctaacctctagagaccctcagttttgtcatatgtaaaatgggggtcgtgtctatttcatagaattgttgcagatttagaaattacatttctaaacaaatgttaccccttatttctaaataagtgtctaaatgaataagtcaccacttttgcccctatttgatggcaagaggtgtgatcttgtggtgggactgtaatcagtcagttctcagtgactgtgccctgctgtggtgtttcctggaatgttcctgtcttgtcctagaaagtctggcaggggcaccctgactccactgtccagtcctctccccagtccctcgggcttctgcagatttgaggcttgtttggatcccagaaggttgtggcaggagacaccttgcctctactttcccctttataattcaatgtccaaagagagccctgagcaggtacctcacgccagctgcctcacggagctcctcctcttcctggctgtgaggatcggtatcagtggcctcctgctctctcccccttgcctaacacgagcacctttgcttacttgggtgcccttgctcttgaactgcccatcggacgtgcgtgacccaagactgtgccgcagtccttgccttgtctgtgctcattttctttgttcatttttttccctgtaacgtaaattgttatatttgtctgtatctgtgtctgaatcagtcctgcacgctctccttctctctgtctcttgttctttctttaccccgtttatcacggggaccccgatgtccattgctctagttctcctgtcctaagcaccccatcccgtctctctggccttaccacaagtggcgtggctgcctcagacatcatgatggggacatgaagcacagctgtcagaaacaactgttcgttagatacactcgaatgcagctcatcaatagggatggagggtctgtcggatgtattttcactgaatccccgttcctaccttgatacactctttttaatctattcttctagacaggtcagaggaaccattactttgacttttaaatttttagcagctttattgaggtagaattcacatactacagatttcacccactctaagcggacagcttggtggccattagttttatccacagagttgtgcagccagctgcacagtctcagggctggactccagggaagattttagcccatttagtgagtggggcagaagtggccctggccctgcacgaggttgcctgcatgggcgtccctgccctgtccctgtgtctgctccactgggggttgaccaggctgccagggccgacttgggcctgtgccacctgcctctcatgtgtctcggacagtgcagccgatgtctatacttcggtttcctcaatgatgaaatggaggggatagtgttccccgcatcatagaactgtgtgaggtttaagggactcactgcccttggcgtggagccttctccaggggccgtgctgtgtcggcgtagctgtcagctctccgttacaggcttgagaagggttgacactctctcatgtaacatttatatttctaggctggaccagtcgtactcagtttgaagaaacttgggccaccctccttggtgtcctggtgacgcagcccctcgtgatggagcaggaggagagcccaccagaagtaaggccacaccctgtgctggttggcacatgggcagttatggccgcttgcaggcctttggtggggaataaaataaggcagcaagctggtgttctttttttctcttaccttatttttgaaagagtagctgaatggtgtcttgactgatattccagagcagggacaaagcctgctgaggtctgggggctgcgattaccaatggctggaatgcattttattacggtgcattccatgttaaggatcaatacgattgtgccctttctggaaaatatcttttagtttatcaatattcagaggagtgtaggttgaattaaaatgaaaaggcactttataaaggccatgagtagtacctggtttcatttttctaatgtcttgcagagattttatcaggcttcttgaagtgttcacgtacattacgctaacacgatattaataataactgtgctctggtacagcggagccagcagaatgggaagttgtggaatgcaggcccttgattctgatagaaggtgtggtttgaactcacagaaatgacagtttggagggtagacatatgtcacaagtcatcaagattgtctttaaattcatgcatagaagctaacagggtgtcataagcaaggcctgtaaaatgtatgagggaattcaaagataatttattaaaaagtaattcatgtttggagttttgtgcccaaaggagtccttgatttgaaaaatgggcttttgcccatcagattgtttcagggcccgtgtgtgcggaggccctgccttgtgccccgtgagctcagcctgacagaaatcctttggtagcacttaaggctcctcttcctcccattgaggcagggaagactctgggttctgcaggcagaggtggttgtgggtgtcttgctgctcttgttgacatgtgggctctccttccaggaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgcttgagttcccacgtgtctctgggacatagcaggtgctggggacagtgggttccccgctgaagcgtccagcagcttcaaccaggccgttttccttcattgctagaattgaaaacaccgtccgtgtggcctgtgcaggagatgcagacccaaaggtggcctcctggtcagtgagaagctggaaacgtgacaggaactgacgtggggttattgagcatttaggggaagacgttagcagagcaggaatgagcaggcaactagtagaacacccacttaagggctcacggacaggtgctcacttaggaagtgagtttcatttggtattacaccaggttcctttaggcaaagcggagggaaagttctggtgtttttcacttgtaagattttgaaggaaacaaaacactctttaccttttttctaaaatgtaggtttgggaggaagctgagcattatcagagggattgtggagcaagagattcaagcaatggtttcaaagagagagaatattgccacccatcatttatatcaggcatgggatcctgtcccttctctgtctccggctactacaggtacctgagggaaagggtgcgggggagcggttgtacttgggctagaatgagagaagactggcatgctcaccacaccagtgatgcgggaagacctgagtgtggtctgagttggaggctgtggtgctaaatacgctgcccctttcataagcaggagtcttagtcaggcccagggaggaagtaaaatctggaaatgaatgagaagcattctctcctgccagtcaagaaatgagaagcgaaagaattctcacgggctgtaagaccagcaggatttaaaagttgaattagttgcttatgttaagaactcaaccaagttcatctacacaagctgaatctccagcttttcctaagaaaccatgtgtggcagtggctgcagggcagggcacagctgggcctgagcaccccgctccctgcacctctcccctccctgggccctgcctgtcactgcccactctcccaccaagccttccggttgtgtgcctgccctatcacaggcatcggagcttgtcacctggtttaaaagaagagagttgtgtggggatttgggatgcacgtttttcactcaaaagtattttagcgtagagctctgtgattccgtagctatttaggagtttaagcaccttgaaggctttaattgcagaaagttctatgtggacgtgcaatgtgttatacgcagtgtctatgagactcaaatgtttattagggcgttgaagtaaactgagcacttggagggccatggatccagccttcaaggagctcataagtcaggaggacccaggagcaatgacctgtcatagaaggcagaaaagaggggcacagaggtgggtgggaggcatacacaggcagctcctggagctccaaggggagcaagtgcttccagggaagggggcgtggaggcccctttggaggaggcaagttgatctggggtctggcagagggttagctggggacatttagcgggaggctggtgcccgggaattggggggatgcccagcagaaagacatgaggaggctggcctggggcgtgggggggtgtgaaaggttaagtgggggcattatcctgctcccgctcctgccggctgtatctggtcagcctgggcaccgaggtggggttctggaaggcactgttcaccaaaatgcttatctgggtcccccagagagcttgcctgcctggactgtcggctcgcctgcaactgctgactcctaagcttttgcagctcagcccacaaccagttcctattcacagaggtgggagctgaggggtgacaagtgactgctgcagtcttatttgtcatagagaaaaagtgacagagtccagcttgcccactggccctgccagcttaactggttataaagtgacaaatccccaagacccacagggctctgcacaacctgggccctcctgccagtggcggcgagggcaggtggctcacggctgggtgcctgtctgggcaggagctgggctggtatggggtgggcctgcggccctgcccccctgtgcagatcaagactcagggtgctggtgttcacaggtgccctcatcagccacgagaagctgctgctacagatcaaccccgagcgggagctggggagcatgagctacaaactcggccaggtcagtctcgcgcccccgccgcctggcctctgtccgtttctgtcctcagactttggcgcttgacacacccaggagaaaagctcagtgcactttttaaatgaaaggaagttttccttttttttaaaaaaaaatttaatgttcattgtttttatctgttttattcctaggtcccgcaagcagaggaagcattagttttgtttttatttatgttctgtattccagaaagtagttaagagacctcacatgtagcgatagagatgtgtgtaagagacagtgagagggcgtgacttggacttaagcaaggaccgtgagacacaaaaaggggggtgaggacagagtggagtcagctgaaatgctcaggaggaagtagacgccatgaagggccatggtatggggggccgcaggcgtggccgtgagtgtccctggggccagctcttggggggctccctgagtgtccctgtccctgtggccagttctgggtgggagccccgtgtgcaggcagacagctcggccacttcctagcaggtcacattggtctgtgcttctgtttcctcctcagataagtgaagggattcaagggtctgggtgtggtggctaacacctgtaatctataacattttaggaggctgaggcaggaggcttacctgagctcaggaggttgaggctgcagtgagccatgattgcaccactgcactccagcctgggcaacagaccagtactctgtcccttaaaaaaaaatgtaaacagaaacgtagggccatttgcatatgatggcacatggcgtggagccctacaggtgtatgctgggcggggcccggctgtgctggccgacttgcacctttccctccaccccggtgctgtgtctttcgctcaccgggttcctgatttagtgaaagcagttgtgcaggacagttctctttgtagcttttgtttctgtggaaatgggtcagaatatggtgtttagaaacacttatgagctctgagagtttcctcttctgagttcctggcctgcagccttcacagcagaaaccctgtgatgtcacaagcctgtttctgttccctgctctctgcctgtactgtcctgttttgtgcctgccggtttcagtgacaggaagcagggagctactggaccagcctgtatttttctagacatagttggaaaaagaagtcccactcttctgtcctttcacctttgacagatgtttccaccccaagataagtgaaaatgaccaataggatgcactgtatttttcatgaaagtgtttctgaagggcaggctgagagtgagaggcctggggctcactgggtgcctctggccttgtcctgggcccagggacactggtctgtgcccgaggtattccctatccccccaaccccgctgcatttggccacatccttcaatgtttgcgttgtgtccagcgtccgcaaaccaactgtcatgggatcatactggggctgaagtacggtcccacccctgccctgtctggggctgaagtacagtgccacccctgccctgtctggggctgaaggacagtgccacccctgccctgtctggggctgaagtacagtgccacccctgccctgtctggggctgaaggacagtgccaccccttccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctgggatgtttagcccctagatgccactggactgagccgctacttgcttttgggaaagaggggtgggggttaggggtctgggcgaggggagtgcaggggctcctccttggcctgagagctgttcatacagactcctcgcccactccctgcagggtgctgggtcccaggggggaaatggcccttggtgccaagaacgtgagttggggctagtgccagtgatgatggagaacagctttttatgggcacacagcccacagcactgtgccaagtgctcgaggcttcccgagaaccaggcagaaaggaggacagtcgaggtgtgctgactgcgtggtggctgcgtgatctagagcgcgggtcacaaaggcgcgagggagctctggccttgggtttaccgcaatgactgccagtgcgggagactggaaaaggaatctcacgtattggttccgtgttttggggactccattcagatgtcacttaggagtgaaagcatcccttcgtagagcctctttctgtgtcaccctcctcagctgctcctggggttgactggcccctgattcatgcctttagcatgtgctggagcttcccagcagctgtccagcccctgccccaccctctctgtgggctcccttgcccgtaacctggggtgtctgaacgacccttgctaaggggcagactgttagacggtaggcatgtgctgagtcccagtggccacacccacccaccaggagcctggcactgtggccgcagcactgagcagtgccccgtttctgtggcaggtgtccatacactccgtgtggctggggaacagcatcacacccctgagggaggaggaatgggacgaggaagaggaggaggaggccgacgcccctgcaccttcgtcaccacccacgtctccagtcaactccaggttttccaatggcctttttctttttaacagaaatttgaaatttcttatcagtcatttgatttgtttgaggtgcttcttgaaatgagcctctcatctcatgtacttggaaaatacccatctcgcatattccacaggaaacaccgggctggagttgacatccactcctgttcgcagtttttgcttgagttgtacagccgctggatcctgccgtccagctcagccaggaggaccccggccatcctgatcagtgaggtggtcagatccgtaagtgagccttcccattcccctcacacctgcacgtgccacacgcaccacacacgccacacaccccacacacacacaccgcccacacacatgccacttgcacacacacccctcatgcatgcaacacacacacaggccacacgcaccatagacaccacacacacatgccacatgcacacacatacacggcatgcaccatacacacaacacacacagcacacatgccacacacacacgccacaccacatgcaccacacacatgccacatgcacacacactccacatgcatgcaccacacacacacacacacaccacacacaccacatgcaccacaccacacaggttacatgcacacaacacacacatgccacgtgcacacaccccacacaccacatgtatgtgccacacacagcacacaaccacacacatgcaccacacacatgccacatgtgcatgcaccagacacatggcacacactacacacacgccacgtgcacacaccccacacacatgtacgcaccacacacatgccacacacacatgcaccacacacatgccacatgtacacacatgtatatacacaccccacaccacacacacaccacttgcacaccacgcacacacaccacatgcgcacacacacaccacatacgccacatgtacacaccatacacacaccatacatgcaccacgtgtaccacgcacccacacagacacagcacacgcatacaccacacacacacgcacacatgcgtcccgcacagtaatgtctcttgggtgtaagaacacgacttgccagtagtagcgttctggatgcgttgcctggattctaacagcgcgattctccccttgccctcctggttttccacatctccagcttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggtaagtgacaggtggcacagaggtttctgtgctgaagccacgggggcccatctgccttgggacctggtgttggccagaggtgccgggtgcggctgcctccttccaagagttgacccgaaccggactccacggcccacgtgagctgcagtgcttctcagatggagggggttcagcgacggtcagtgccattcacaggtcactgtgatgtgggttgtggcggccaagccatggtttggggtcccgtatccctgggcttatgacatcattgtagtagcccatccccacagaaccacggtgtgtggtggcgctgaggcatcgtagatggtggaaatgctactggcttccccatgctctgccctgaggcctgactgcctcactccccttctcagttatgttccaggccccccgagcttcctggctggacagcttctctcctgggggccgttttgtcacagtgaccctgtgtttctagtcccaaatctgggtgctatagtctctttttagcgtggtggttgtcttagtcttttttggctgctaccacaagttaccttagactgggtaatttataaacagtggaaatttacttctcaccgttctgggggctggaagttttcatggtcaaggtgccagcagatttggtgtgtgatgagggctgctctctgcttcatagatggcatcttctggctgggtcctcacggtggaaggagtgaacaagctccctcaggccttttagaagggccccaatccacaagggctctcccatcatgacctcatcacctcccaaggccccaccttcttgtactgtggcactgcaaattaggtgtcagtgtaggagtttcaggagggatagaaacattcagaccatcccagcggtcaagtgttcatcctcttgagttcctccttattctgcttctggtttatcaggattcagccagtgcagcatggtacctgtattctgtggcacatcaccacatggtatttgccaagtatccatcacctgcacacgtgaaatcattgcccgtgggtcccgacatctggcgaagcatattcaaggatggcagaactgtcagagctggcacctctggttccttgtcatgtggcattacctagtaatccattttatgatagcaatggaaactcatttcttcaacaaacacctgagtggctgccgtgtgccagccgtctggggcccttggtgagaatggcatggtggtgcccatcagggcctgcctagcccgtgctctggacgggctcctgtgtgtcaggaacgacaatgctgtcatgacggtgaatgatttttttttttgccatcactccagccgctaacatttgcggagctcttcctcccgcacccccacctgacaaggccaagggtgaccttggccccaccctaggcggccaaggtcagaggttagctggcttgtctgggtcacacaaaatgcagcagaggttgaggtgagcacatgtccgtgacctggagcctgactccctctctgcgagtcttgactgctcttgcctagactctgtcctccccgagcccaaacgccagtcatcttcccttgtgggtgtccttcagcctggtgccatgctggtgactcagcagccgtccagggagtggaaacaattgagtgtgtgggttccctgtgtgggcatctctcttcacggcgaacaccctctgggtgttgcccacacgatgtcaaagcggctcttggaaggggtccttctcctttgtgggaagtttcagctgctgggctaacttgaattgtaactgtggttttgtgctcaggcccagatccccctaggcaagtgttgtgccatcagtaatcaaatgagaaataatcattttgaaaagcagatcctaaggcaggatggtcatggacactcactcccagctctttgtgcactcatgctttctggaagatggccatcctctgtgaaggttttcagcgcgtcatgcttggtacccacgtatccagagcatgtcgttttgaggtatttgcccaccgttgtgaaatccgtgccacccgagagcaggtcctgatgtggggctttcagaagtgggacctggggccgtacgcagtccttagggaggggccgtgtggcgttgtgcgtgtgaggggatagcacagggtgaggtgggggcccaagaaggaagtgacccacaaagaacagcctcctcttttggtccttgttcctgggatggctgggagtggcttctgtgtcgtccggccatttcccctgcggagaggctcctaccactgccgagaacctcatcattccacaaaaacaagaggccgcctggccatccagcgctccatgggaattctgtgtccccatagtcttgggctgaaggagggtgacattccttgctgacttctgcaggggtctcctcactgttaaagagcagattgaaagtgaagaacgtgggctaagtgtttaggtcgatatttaaccctgctaggttttggatactaagtgaaattgaggccattttggttgaagttgacagaaaccactatcagggatccccaagactaccccaggcttttctagaaagactctcagctaagatgtgttatggtaaaagcacacaaaacaaaatcagcaaagaaaattagcaagggcagaggcccatggggcgatgtcccgaggacaccaggcttgagcttccagaatcctctcccagcggggtcgtgcaggacgcacttaactccccgcacagtgagccgtgacagcgcgtgtgcagtgtcgtcgccaggaaagcacactagagactcggtgccagggtttttactgggggctgggcacatgggcaccctctgcctgcctcgtgcccagactctggactcccggagggaaggcaagttctcagcaccaaccctggtgcccacacaagcagctgagcacagggagcccctcctcagtgaggatggtgggcaccgtcccaacaccagccaggggccagccttgcacacaggcctctcaggatggtctccggcctgctgtgtagtctcttctgcacacaagcgtgagggcagcgcccccgcctcggctgtggggaggagccactgggacgtgagctctggtggcatgcagcagcttttgtctgtgtgtgcctaggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccagtgagtgggagcctggctggggctggggcgggggtctcagaatgagctgtgaaggaagcagcatcaccctctccaagtgcccaggctcctggccagatggcaggccaggtatcagtgggaacccaggtgggtgccatggctgaggtcagtgagacgcaagagcacaggtgcgtcctagaggcttcctcgggcacctccagcgagctggagctctcgcctctgctgctgtctcatgtggcgcttagcacactctcccacgtgcccattcctgactctgctctcgaggccatcggctctcattctctgctcccagaaccctgttattacccaggctagcctcctctctgcaccttccccgccctggcccagtacctccctcttgtttccactgtgattccgacctcaccttatcttaaagctgctggacggcaggttctgtacacacgtgtccttgacaaagcacggctggtgccgcaacccctcagcgagcaagtcaagctcttcacagcgatgtcttacaagcgcagagggctctgtgacaccctggtctcaccgccactcttccaaagtcgcagaggctttagcagagatgggcccagcctctctgagtcataggcttctgcacacgggagctgtctttagagggagggtggaatttcatcagccacccacatgggggagttgagggcaagaattaggagcaaagatgggaaggggtctgggaggaatggccagtgatcccctttgacaagtgggcaggaaacgggggctaggtcaaagttgagtggaagacctggagggagacgggaaggtctctgtaggcacagttcagacaggagggaggtgtgagccagggcacatgccggtggccgtctggcaggatttgggacatgctggagcagggacagcggctcatcaggggccattgccctcatccaggccagagtgtcacaagcccgtggggaggcccttctcgcctgtcatccttgctgggcagtgggtgctgtgctagcaggacaggcggacggctggcaactgtctctgcatccctggagcctggcatagggccaagtcacacggggcacaggcctgcaaatcaggcacatatgttggtgcagtgacgtgattttggggggcagccccagaacaggccccagacacaggccaaagccctgcctgtgctggtgtgttgggctgttctatggctcttgctgtgggcatggaggactcagggaaggagagttgaggtggtccaggagttgcgtttgggatgcagagagcttgtggcatccaggtagaaatggtgcgtggggctgacctcagcaccatgggcagaggggccgtgtcacgtgcctccgaggtggaggtgggaccacgtggtgacagatatacgcatcactgggcacgtttttgtgggtgttggggggcatcgtattggctcctctgttcacagtggccactcattcagtccctggctaccaggtcctcactgtgccatggggaaggccggcgctgtcgggggatcacagaaggcagcacgtcatgatggcatgtgccatgaaggaaaagcacagggcactcaggaagtagaggggactggcctggggtgtgggaatctagggcctcgttgagggacagagagaggaagtgtgtggtggccagcatggaggtggccacaggggaggctgagttaggccgagagggcagggcgttggggaggtagacgggctcagccactcagggagtggtcaagcagaggctgaagggtcaggccaggttgcaggggcctgggggagccactcagggtaggcgctcccgggagcccgcctggcccatagctctacactcccgcgtggggccggacatgctgtgaagccctctccacgttggatgggggtggctgagcctggatgctgtctcccgttttcagctgcgtgaacattcacagccagcagcacgtactggtcatgtgtgccactgcgttttacctcattgagaactatcctctggacgtagggccggaattttcagcatcaataatacaggtgagtgggccctggctgtcttcctctgcacacggggagtgggcttcccttctcttttccttgcaggatcataccagtgggccagttttgacttggtcgggaggaggcatgaacacctgagactgtgcagcgattctttgacacagaggcctttctccctgtgcagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggtgagcatgtacacggtgcccataaggccagcccaagtcctgttcaagggaggcaggagcatgctcactcaagggacctcgactaggtgccctctgatttcacacttctggtgttgccccaagccggccccatcaccttgcaagaaaggctctggagcccccagggctggagtacctggtcagggttgaccgtccctgtggtcactcatcccatgtggctgagctgggctgggtcctgggcaagcaaggggctgatatcacctgctttcagatctccagggactcactggacccctgtgtacaaagcactgtctacagagcctattgggttgtatagaggtaaccttcgtactgaacacttttgttacaggaaaggagaaagtcagtccgggtagaacttcagaccctaatcctgcagcccccgacagcgagtcagtgattgttgctatggagcgggtatctgttctttttgataggtaagaagcgaagccccatccctcagccgttagcttccctagaactttggcctgaagctgtgcttttgtgtgtgtctgctgatcccctggcgctgttgctggagtcctgccagtgattccccaccacagcctgaccatgggctgccttggctcagggttccactggcgagctggtggtccttggaccccagcactcaggtgtagcgttgaccagttccaaggttgtcccagtgcctgcccatctctcctgagggctcagggacagtacctggcagttgggggtgtggcagggggcaggaatgaccagcctctgggagggtggggcagaagcctgtacagtgaggaggagctggctcagcctggctgcctatcgtgagaggggagcccacggggctgtgggaggggggccgtggtgcctgtgagcagggtgaggagcagcggcaggaggatgaaggtggaacccacacatgcatctttgagacccgtgtggtcagtggcttctgccccccaccaccccccactgctgtgcgtgcatagaattggcttccctcacctgctctggaagtgggttaggagcttggtagggctttttctcaaggacaagggcccctgatttgctctcaggcctcagtcctggcgacatggtggatctggagccttgttgcactgccttgcctgtgctctccaatcagggtggccagtggggagccatttggcttttctcaagagcatactcaggtggaccttgctccactgtttgaccagatgaggcattctgaacagccaagcctgtgctggtctgttttcatgttgatttttttttttcttttctttttgagatggagtttttcccttgtcacccaggctggagtgcaatggtgtgatctcggctcactgcaacctccgcctcccgggttcaagtgattctcctgcctcagcctccctagtagctgggattacaggcacacaccaccatgcccagctaatttttgtgtttttagtagagacggggtttcaccgtgttggctgggctggtctcgaactcctgaactcaagtgatccaccctccttggcctcccaaagtgctgggattgcaggcgtgagccactgcgcccggcccccatgtcgatttttaaatgcacctctgcatcgttcttcagtccccatatgctcactgagcaccactgcgactggcagacgggcacagggaggcgccacgaccagtcctggccttcaaggggcttgtggtctagtgggcccaatgctaggtggcgagtgctccaaagagtgtggtgcacgccttccgcttgaccgctctccagacgccacagggaggcacctcgcagctgaccacagatttctctctgtggagcagtgtcttcagagcggctgccatgccactgctgggcgagggtctgcgggcgggtagagccaggagcacctgtgaggaagtgcactgccattttcgtagctgcttcccgtgtgtctcagttacacacggctggcatgtgtgcactgatgagacgggaacgtgatggttgcttttcagcactgaaagggatactgctcagggggcgtgtttcaggatctggttagggaagaagcagcgagagcacagatggggccctgtgtggtaacaagaaaaaagtcctggttgacaacagtgccacgaagcgttagaacacatagggatgtttgtggagcatttgcatgtggaaagcagcaaaaacataatgggaacgggttcttttgttatgatttttaaaaatctcttttgtaacatccttcccgctgcgccgtttctgcatattcctttatgtagctttcaaactcctcttaggagttctggtccctacagggcgtgggagcccaggctttacgtagctttcaaactcctcttaggagttctggtccctacagggtgtgggagcccagggcctgtgccgagcagcctgcctccacgagctagacagaggaagggctggggttttgcctttttagtctcaaaattcgtactccagttgcttaggctctgactttccccacttggaaagtccctcacggccgagggtccctcccagccctgatttcacatcggcattttccccagtattagagccaaggccctccgcgggcaggtggggcagctgtgggagctggtgccagtctctgacctgcgtccctcctcccaggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgaggttgcatgtgggatggggatggagtgggaaagcctggaggtggagttgcctccgacttcccagcagattcgccagcagagcccagctcctccgctttaaagcagcaatgcctctggcccccaccccacccccgccacccaggcgcagcaggtgcttcccgtccccccagccctgacactcaggcacctgcttgctccttgcaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatgtatcctctctgggtccctggtgctggccccgtttcccttgtcaacaccgaggctcatgtttcatgataaggttttgaaacctaacctttgcaaaaaccccacagatgccagggtgacaggccctcagccccagggaagtaaaatgctgacaggggtacagaaaggagcacgtccagacatttgctgaccagggcctctcagaggggccggtgtatggcaggagggtcgcagctgaggggcctttctgtggagggcctgggtgaggggagcgagggtgggcggtggtctctgcagacgtcccgcccactcgcgggctctgtgtggctgggcttctcctgacactgcttctcattagctttggtcattgtgcctcgatcgccctctcggggaaaggcttaagtaaagatccagttcccacccccagatgctggctgccaggagtttccctttccacagcccttccccaagacagaccacaagagcctccaagcagcacagttgtcctggtgctgacagcacagccttgcccggcgtgcctggcacggctctgccctcactgcattggagcagggctagtggaggccagcggaagcaccggccaccagcgctgcacaggagccaggccaggtgagtgctgccgagtgggtgccctgcctgcagggcatccagccagccaagggttgcaggaatggaggtggaggcgctgatgcagctggaggcatccaggtggcccttccggggctctgctcgctctccaggctccctggacccctttgtagactgtttcaggagaggaactcccaggtgaggacagggaggcagcattcccctcatttgccggcctttttccttaactcctgcaccagcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgcggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatcagttgttgctgtgtgaggcttgctttgcttcatgagaacctagaccttgctgagctggagtcttaggaagcagtctcctaagtgcttctccagcaggggcagaaactgtcccaccagctaacatctggcattatggagggtcccccaggcagctgccagcagggacaggccccgtgttttctgtagccagggatgaggaagtggccccagggcatgggcctggctgggtgcttctgcaagggccttcccaaaccacagtacaggtggtcttcctgccctgcagatgggagctgtgggagctgctggagctgctggagccttcatggtcaagtgacatcataagcttatatgacatacacaagcctcaggacttggcccatggcactgaagcaggtcatcaggcccagcacagagactagagctgtgttctcacagggcccaccacccttccacctccttggccattgacacctgcgtccctggcccagctgctcccaggtaacccccaaagcagctggcacatcccacctctggtgtggccggggctgctgtgtgtccgcagggcctgccccgtctattctagcttgtttgtcctgtctgaaccagcgcctactccaagaagcctctgctcagcccagcggggatgcttctaagctccggacgagcctctcggaagccttggtgattggtggtgtagtcatcttgggatgcagatgtcttaccaacctgcaagaacaaaaaccctgtggcttcctctggtgcagggtatttagtcaatgtttgctgaggtcccgtctggttctggctaattggcaggggtcgtccacccattctttccctgctctgctgtctgtgccaggagagacgggggccagtcggccaaggggccagctcctgctgcctgctcctcttgggcacgtgcgggggccccctttctctgagcagggatagggatcagtctgccggagggatgtggtggacaggcctaaagcatttggggcggggcatgccacttgagctccctaaatctgtctcctcataggtgacaccgctccagggccccccagtggcctctcctttcagagctacctaaattctggtcacttcagagaaatggagcacccccttctccctggtccaggtgtggacagcctggcacactgagcacacctggcatggctggtaatttcagaaagaagaggggccggggtccagtgggaagcagcggtgaacccctcgtgagtgggctttgcagtccctccccatgccacggcagagctgccctcaacacagccttcctcttcctcatcggagagcacaccctgtccccttgccgagctgtgccctgtgccttcggtggtatttgattttggctgctactggctttgttgggatctggaagtcgcttcccctgcgtggtgcgtggagcactgtaagtcagatgagggaagtagccagggtgaggtgagtaccgggtggagccgccactgaagggactgggtaggggggccttgcctctacatgatgtgacacagccaaccgaggacagaggaagccccgttcctgggggtgtggggtgcacccctcagggaagcctgcagtggggcctgaggaaaggcatcctccgcgagcccacgagtctggtccatgagcaccgtgacagtgtctgtgggtagaggtggacccggccttgtgtcatcaccaggacctcttttgggaaaccatgtggacatcgcttgcgggtcccccaggctctgcagccccagcagcct

SEQ ID NO: 6 - DNA, 3059 bp, Mus musculus
ggcactcgccgcgagggttgccgggacgggcccaagatggctgagcgccttggttccgcttctgcctgccgcgcagagccccattcattgccttgctgctaagtggcgccgcgtagtgccagtaggctccaagtcttcagggtctgtcccatcgggcaggaagccgtcatggcaaccctggaaaagctgatgaaggctttcgagtcgctcaagtcgtttcagcagcaacagcagcagcagccaccgccgcaggcgccgccgccaccgccgccgccgccttcgccttaaccccctcagccgccgcctcaggggcagccgccgccgccaccaccgtcgctgccaggtccggcagaggaaccgctgcaccgaccaaagaaggaactctcagccaccaagaaagaccgtgtgaatcattgtctaacaatatgtgaaaacattgtggcacagtctctcagaaattctccagaatttcagaaactcttgggcatcgctatggaactgtttctgctgtgcagtgacgatgcggagtcagatgtcagaatggtggctgatgagtgcctcaacaaagtcatcaaagctttgatggattctaatcttccaaggctacagttagaactctataaggaaattaaaaagaatggtgctcctcgaagtttgcgtgctgccctgtggaggtttgctgagctggctcacctggttcgacctcagaagtgcaggccttacctggtgaatcttcttccatgcctgacccgaacaagcaaaagaccggaggaatcagttcaggagaccttggctgcagctgttcctaaaattatggcttcttttggcaatttcgcaaatgacaatgaaattaaggttctgttgaaagctttcatagcaaatctgaagtcaagctctcccaccgtgcggcggacagcagccggctcagccgtgagcatctgccaacattctaggaggacacagtacttctacaactggctccttaatgtcctcctaggtctgctggttcccatggaagaagagcactccactctcctgatcctcggtgtgttgctcacattgaggtgtctagtgcccttgctccagcagcaggtcaaggacacaagtctaaaaggcagctttggggtgacacggaaagaaatggaagtctctccttctacagagcagcttgtccaggtttatgaactgactttgcatcatactcagcaccaagaccacaatgtggtgacaggggcactggagctcctgcagcagctcttccgtacccctccacctgaactcctgcaagcactgaccacaccaggagggcttgggcagctcactctggttcaagaagaggcccggggcagaggccgcagcgggagcatcgtggagcttttagctggagggggttcctcgtgcagccctgtcctctcaagaaagcagaaaggcaaagtgctcttaggagaggaagaagccttggaagatgactcggagtccaggtcagatgtcagcagctcagcctttgcagcctctgtgaagagtgagattggtggagagctcgctgcttcttcaggtgtttccactcctggttctgttggtcacgacatcatcactgagcagcctagatcccagcacacacttcaagcagactctgtggatttgtccggctgtgacctgaccagtgctgctactgatggggatgaggaggacatcttgagccacagctccagccagttcagtgctgtcccatccgaccctgccatggacctgaatgatgggacccaggcctcctcacccatcagtgacagttctcagaccaccactgaaggacctgattcagctgtgactccttcggacagttctgaaattgtgttagatggtgccgatagccagtatttaggcatgcagataggacagccacaggaggacgatgaggagggagctgcaggtgttctttctggtgaagtctcagatgttttcagaaactcttctctggcccttcaacaggcacacttgttggaaagaatgggccatagcaggcagccttccgacagcagtatagataagtatgtaacaagagatgaggttgctgaagccagtgatccagaaagcaagccttgccgaatcaaaggtgacataggacagcctaatgatgatgattctgctcctctggtacattgtgtccgtcttttatctgcttcctttttgttaactggtgaaaagaaagcactggttccagacagagacgtgagagtcagtgtgaaggccctggccctcagctgcattggtgcggctgtggcccttcatccagagtcgttcttcagcagactgtacaaagtacctcttaataccacggaaagtactgaggaacagtatgtttctgacatcttgaactacatcgatcatggagacccacaggtccgaggagctactgccattctctgtgggacccttgtctactccatcctcagtaggtcccgtctccgtgttggtgactggctgggcaacatcagaaccctgacaggaaatacattttctctggtggactgcattcctttactgcagaaaacgttgaaggatgaatcttctgttacttgcaagttggcttgtacagctgtgagggtgagtacaatgctttacataaactgttccttgccttagtgagcttaccattgatacagttaaatttggagcttaataggtcacatttccgtaagttgtaaacagttcttttccgaaatttaccactcagcctttgaaaaaacgttgccatcatattaaaattcattaaaacttttaattcttggactccttatttgaaacgttcttttctctaaagatagtgtttagaaatatacctttgctattttgaaatataaagtttgttgaataattacaattactgttttaagatactagaatgttgagctgcaatgaaattatgggtgttatttaactgggcctttactaaaagagccttgattcctcaagtgacagtaaggtgaaacatttcctattagctgcatcataagtcacaattgggcattcagtagcagaaaatttaactagagaaaatc

SEQ ID NO: 7 - DNA, 1375 bp, Mus musculus
tcataagtcacaattgggcattcagtagcagaaaatttaactagagaaaatcaaaacaaaaacagtgattaagtctcaggaagggactatcattctttttagaaatgtaatggcctcaaagtagtgtttttctagatctaattttttaaaaagattttatttttttaatggtgtatatgtgtgtgtgtgtgtgtgtgtgtgtcagagtatgtcagagtgtgagtttctatctgtgagggtaatagcaacagatgccagaagagggcactggatcccctaaaactggaattctaggtgactatgagccacctgatgtggatgctgggaaccaaactcgggtccttcagaagagcagtaagtaggcacttttgaccagtgagccatctttccagcccccagcaccattgggtttttttgcttttttttttttttttttttttaagttaagttttagttagttgtgtcttttgagcaatgaaggcatgctgatagcacaggtgctatgctgatagatataagtgtgttatccttgtataggataactacaggataattaatgcctttaagctctgaggctgaaggtcctatagcaatataagatccaccttgattccttccttgtccatcaagaaagttgagtcacatctaagatactctttgatatgggtctcttctccttatgctggacctgagacttcttttcacatgtggcaggactatgttgtgtcatcttcctctaaaccagtggttagtgttcctgagattgaggctcaagagtcaaggcaagtaatcagaggcagaaagaaacaaaatataatgggcacatttacttttaaactcaagcataataagataaagatgtatcttgagtacttctgggaacctgtattgcttcttgttgctgcttaaagatagactagaacaaacaggtgcatgcataagagtgctgttcaaagacgcggtgcggtgtctgacctgatgccttctgtggtgggatgggctttcagcactgtgtcctgagtctttgcagcagcagctacagtgacttgggattacaactgcttattgatatgctgcctctgaagaacagctcctactggctggtgaggaccgaactgctggacactctggcagagattgacttcaggtaagggagccaagttacaattcagaagttcaaattaaaaattgaaagtcctgaggtctctgcagttggcatggctgtcatgtgtactgtctgttcagctcatctccagtttagttagagaacatgtgatagtcacagtactttttattgaactctgaacttggagattttgctattttaaatgagataagtttttctggttgtcctgtttttctagatggtaggagt

SEQ ID NO: 8 - DNA, 9992 bp, Mus musculus
  misc_feature 3103: n is a, c, g, or t
ggttccgcttctgcctgccgcgcagagccccattcattgccttgctgctaagtggcgccgcgtagtgccagtaggctccaagtcttcagggtctgtcccatcgggcagtaagccgtcatgggaaccctggaaaagctgatgaaggctttcgagtcgctcaagtcgtttcagcagcaacagcagcagcagccaccgccgcaggcgccgccaccgccgccgccgcctccgcctcaaccccctcagccgccgcctcaggggcagccgccgccgccaccaccgccgctgccaggtccggcagaggaaccgctgcaccgaccaaagaaggaactctcagccaccaagaaagaccgtgtgaatcattgtctaacaatatgtgaaaacattgtggcacagtctctcagaaattctccagaatttcagaaactcttgggcatcgctatggaactgtttctgctgtgcagtaacgatgcggagtcagatgtcagaatggtggctgatgagtgcctcaacaaagtcatcaaagctttgttggattctaatcttccaaggctacagttagaactctataaggaaattaaaaagaatggcgctcctcgaagtttgcgtgctgccctgtggaggtttgctgagctggctcacctggttcgacctcagaagtgcaggccttacctggtgaatcttcttccatgcctgacccgaacaagcaaaagaccggaggaatcagttcaggagaccttggctgcagctgttcctaaaattatggcttcttttggcaatttcgcaaatgacaatgaaattaaggttctgttgaaagctttcatagcaaatctgaagtcaagctctcccaccgtgcggcggacagcagccggctcagccgtgagcatctgccaacattctaggaggacacagtacttctacaactggctccttaatgtcctcctaggtctgctggttcccatggaagaagagcactccactctcctgatcctcggtgtgttgctcacattgaggtgtctagtgcccttgctccagcagcaggtcaaggacacaagtctaaaaggcagctttggggtgacacggaaagaaatggaagtctctccttctacagagcagcttgtccaggtttatgaactgactttgcatcatactcagcaccaagaccacaatgtggtgacaggggcactggagctcctgcagcagctcttccgtacccctccacctgaactcctgcaagcactgaccacaccaggagggcttgggcagctcactctggttcaagaagaggcccggggccgaggccgcagcgggagcatcgtggagcttttagctggagggggttcctcgtgcagccctgtcctctcaagaaagcagaaaggcaaagtgctcttaggagaggaagaagccttggaagatgactcggagtccaggtcagatgtcagcagctcagcctttgcagcctctgtgaagagtgagattggtggagagctcgctgcttcttcaggtgtttccactcctggttctgttggtcacgacatcatcactgagcagcctagatcccagcacacacttcaagcagactctgtggatttgtccggctgtgacctgaccagtgctgctactgatggggatgaggaggacatcttgagccacagctccagccagttcagtgctgtcccacccgaccctcccatggacctgaatgatgggacccagccctcctcacccatcagtgacagttctcagaccaccactgaaggacctgattcagctgtgactccttcggacagttctgaaattgtgttagatggtgccgatagccagtatttaggcatgcagataggacagccacaggaggacgatgaggagggagctgcaggtgttctttctggtgaagtctcagatgttttcagaaactcttctctggcccttcaacagacacacttgttggaaagaatgggccatagcaggcagccttccgacagcagtatagataagtatgtaacaagagatgaggttgctgaagccagtgatccagaaagcaagccttgccgaatcaaaggtgacataggacagcctaatgatgatgattctgctcctctggtacattgtgtccgtcttttatctgcttcctttttgttaactggtgaaaagaaagcactggttccagacagagacgtgagagtcagtgtgaaggccctggccctcagctgcattggtgcggctgtggcccttcatccagagtcgttcttcagcagactgtacaaagtacctcttaataccacggaaagtactgaggaacagtatgtttctgacatcttgaactacatcgatcatggagacccacaggtccgaggagctactgccattctctgtgggacccttgtctactccatcctcagtaggtcccgtctccgtgttggtgactggctgggcaacatcagaaccctgacaggaaatacattttctctggtggactgcattcctttactgcagaaaacgttgaaggatgaatcttctgttacttgcaagttggcttgtacagctgtgaggcactgtgtcctgagtctttgcagcagcagctacagtgacttgggattacaactgcttattgatatgctgcctctgaagaacagctcctactggctggtgaggaccgaactgctggacactctggcagagattgacttcaggctcgtgagttttttggaggcaaaagcagaaagtttacaccgaggggctcatcattatacagggtttctaaaactacaagaacgagtactcaataatgtggtcatttatttgcttggagatgaagaccccagggttcgacatgttgctgcaacatcattaacaaggcttgtcccaaagctgttttacaagtgtgaccaaggacaagctgatccagttgtggctgtagcgagggatcagagcagtgtctacctgaagctcctcatgcatgagacccagccaccatcacacttttctgtcagcaccatcaccagaatctatagaggctatagcttactgccaagaataacagatgtcaccatggaaaacaatctctcaagagttgttgccgcagtttctcatgaactcattacgncaacaacacgggcactcacatttggatgctgtgaagccttgtgtcttctctcagcagcctttccagtttgcacttggagtttaggatggcactgtggagtgcccccactgagtgcctctgatgagtccaggaagagctgcactgttgggatggcctccatgattctcaccttgctttcatcagcttggttcccactggatctctcagcccatcaggatgccttgattttggctggaaacttgctagcagcgagtgcccccaagtctctgagaagttcatggacctctgaagaagaagccaactcagcagccaccagacaggaggaaatctgccctgctctgggggatcggactctagtgcccttggtggagcagcttttctcccacctgctgaaggtgatcaatatctgtgctcatgtcttggacgatgtgactcctggaccagcaatcaaggcagccttgccttctctaacaaaccccccttctctaagtcctattcgacggaaagggaaggagaaagaacctggagaacaagcttctactccaatgagtcccaagaaagttggtgaggccagtgcagcctctcgacaatcagacacctcaggacctgtcacagcaagtaaatcatcctcactggggagtttctaccatctcccctcctacctcaaactgcatgatgtcctgaaagccactcacgccaactataaggtcaccttagatcttcagaacagcaatgaaaagtttggggggttcctgcgctctgccttggacgtcctttctcagattctagagctggcgacactgcaggacattggaaagtgtgttgaagaggtccttggatacctgaaatcctgctttagtcgagaaccaatgatggcaactgtctgtgtgcagcagctattgaagactctctttgggacgaacttagcctcacagtttgatggcttatcttccaaccccagcaagtctcagtgccgagctcagcgccttggctcttcaagtgtgaggcccggcttatatcactactgcttcatggcaccatacacgcacttcacacaggccttggctgacgcaagcctgaggaacatggtgcaggcggagcaggagcgtgatgcctcggggtggtttgatgtactccagaaagtgtctgcccaattgaagacgaccctaacaagcgtcacaaagaaccgtgcagataagaatgctattcataatcacattaggttatttgagcctcttgttataaaagcattgaagcagtacaccacgacaacatctgtacaattgcagaagcaggttttggatttgctggcacagctggttcagctacgggtcaattactgtctactggattcagaccaggtgttcatcgggtttgtgctgaagcagtttgagtacattgaagtgggccagttcagggaatcagaggcaattattccaaatatatttttcttcctggtattactgtcttatgagcgctaccattcaaaacagatcattggaattcctaaaatcatccagctgtgtgatggcatcatggccagtggaaggaaggccgttacacatgctatacctgctctgcagcccattgtccatgacctctttgtgttacgaggaacaaataaagctgatgcagggaaagagcttgagacacagaaggaggtggtggtctccatgctgttacgactcatccagtaccaycaggtgctggagatgttcatccttgtcctgcagcagtgccacaaggagaatgaggacaagtggaaacggctctctcggcaggtcgcagacatcatcctgcccatgttggccaagcagcagatgcatattgactctcatgaagcccttggagtgttaaataccttgtttgagattttggctccttcctccctacgtcccgtggacatgcttttgcggagtatgttcatcactccaagcacaatggcatctgtaagcactgtgcagctgtggatatctggaatcctcgccattctgagggttctcatttcccagtcaaccgaggacattgttctttgtcgtattcaggagctctccttctctccacacttgctctcctgtccagtgattaacaggttaaggggtggaggcggtaatgtaacactaggagaatgcagcgaagggaaacaaaagagtttgccagaagatacattctcaaggtttcttttacagctggttggtattcttctagaagacatcgttacaaaacagctcaaagtggacatgagtgaacagcagcatacgttctactgccaagagctaggcacactgctcatgtgtctgatccacatattcaaatctggaatgttccggagaatcacagcagctgccactagactcttcaccagtgatggctgtgaaggcagcttctatactctagagagcctgaatgcacgggtccgatccatggtgcccacgcacccagccctggtactgctctggtgtcagatcctacttctcatcaaccacactgactaccggtggtgggcagaggtgcagcagacacccaagagacacagtctgtcctgcacgaagtcacttaacccccagaagtctggcgaagaggaggattctggctcggcagctcagctgggaatgtgcaatagagaaatagtgcggagaggggcccttattctcttctgtgattatgtctgtcagaatctccatgactcagaacacttaacatggctcattgtgaatcacattcaagatctgatcagcttgtctcatgagcctccagtacaagactttattagtgccattcatcgtaattctgcagctagtggtctttttatccaggcaattcagtctcgctgtgaaaatctttcaacgccaaccactctgaagaaaacacttcagtgcttggaaggcatccatctcagccagtctggcgctgtgctcacactatatgtggacaggctcctgggcacctcctcccgtgcgctggctcgcatggtcgacaccctggcctgtcgccgggtagaaatgcttttggctgcaaatttacagagcagcatggcccagttgccagaggaggaactaaacagaatccaagaacacctccagaacagtgggcttgcacaaagacaccaaaggctctattcactgctggacagattccgactctctactgtgcaggactcacttagccccttgcccccagtcacttcccacccactgggtggggatgggcacacatctctggaaacagtgagtccagacaaagactggtacctccagcttgtcagatcccagtgttggaccagatcagattctgcactgctggaaggtgcagagctggtcaaccgtatccctgctgaagatatgaatgacttcatgatgagctcggagttcaacctaagccttttggctccctgtttaagccttggcatgagcgagattgctaatggccaaaagagtcccctctttgaagcagcccgtggggtgattctgaaccgggtgaccagtgttgttcagcagcttcctgctgtccatcaagtcttccagcccttcctgcctatagagcccacggcctactggaacaagttgaatgatctgcttggtgataccacatcataccagtctctgaccatacttgcccgtgccctggcacagtacctggtggtgctctccaaagtgcctgctcatttgcaccttcctcctgagaaggagggggacacggtgaagtttgtggtaatgacagttgaggccctgtcatggcatttgatccatgagcagatcccactgagtctggacctccaagccgggctagactgctgctgcctggcactacaggtgcctggcctctggggggtgctgtcctccccagagtacgtgactcatgcctgctccctcatccattgtgtgcgattcatcctggaagccattgcagtacaacctggagaccagcttctcggtcctgaaagcaggtcacatactccaagagctgtcagaaaggaggaagtagactcagatatacaaaacctcagtcatgtcacttcggcctgcgagatggtggcagacatggtggaatccctgcagtcagtgctggccttgggccacaagaggaacagcaccctgccttcatttctcacagctgtgctgaagaacattgttatcagtctggcccgactccccctagttaacagctatactcgtgtgcctcctctggtatggaaactcgggtggtcacccaagcctggaggggattttgggacagtgtttcctgagatccctgtagagttcctccaggagaaggagatcctcaaggagttcatctaccgcatcaacaccctagggtggaccaatcgtacccagttcgaagaaacttgggccaccctccttggtgtcctggtgactcagcccctggtgatggaacaggaagagagcccaccagaggaagacacagaaagaacccagatccatgtcctggctgtgcaggccatcacctctctagtgctcagtgcaatgaccgtgcctgtggctggcaatccagctgtaagctgcttggagcaacagccccggaacaagccactgaaggctctcgataccagatttggaagaaagctgagcatgatcagagggattgtagaacaagaaatccaagagatggtttcccagagagagaatactgccactcaccattctcaccaggcgtgggatcctgtcccttctctgttaccagctactacaggtgctcttatcaaccatgacaagctgctgctgcagatcaacccagagcgggagccaggcaacatgagctacaagctgggccaggtgtccatacactccgtgtggctgggaaataacatcacacccctgagagaggaggaatgggatgaggaagaagaggaagaaagtgatgtccctgcaccaacgtcaccacctgtgtctccagtcaattccagaaaacaccgtgccggggttgatattcactcctgttcgcagtttctgcttgaattgtacagccgatggatcctgccatccagtgcagccagaaggacccccgtcatcctgatcagtgaagtggttcgatctcttcttgtagtgtcagacttattcaccgaacgtacccagtttgaaatgatgtatctgacgctgacagaactacggagagtgcacccttcagaagatgagatcctcattcagtacctggtgcctgccacctgtaaggcagctgctgtccttggaatggacaaaactgtggcagagccagtcagccgcctactggagagcacactgaggagcagccacctgcccagccagatcggagccctgcacggcatcctctatgtgttggagtgtgacctcttggatgacactgcaaagcagctcattccagttgttagtgactatctgctgtccaacctcaaaggaatagcccactgcgtgaacattcacagccagcagcatgtgctggtaatgtgtgccactgctttctacctgatggaaaactaccctctggatgtgggaccagaattttcagcatctgtgatacagatgtgtggagtaatgctgtctggaagtgaggagtccaccccctccatcatttaccactgtgccctccggggtctggagcggctcctgctgtctgtgcagctatctcgtctagacacagagtccctgggcaagctaagtgtgggcagagtgaatgtacacagcccacacagggccatggcagccctaggcctgatgctcacctgcatgtacacaggaaaggagaaagccagtccaggcagaacttctgaccccagccctgctacacctgacagcgagtctgtgattgtagctatggagcgagtgtctgttctctttgataggatccgcaagggatttccctgtgaagccagggttgtggcaaggatcctgcctcagttcctagatgacttctttccacctcaagatgtcatgaacaaagtcattggagagttcctgtccaatcagcagccatacccacagttcatggccactgtagtttacaaggtttttcagactctgcacagtgctgggcagtcatccatggtccgggactgggtcatgctgtccctgtccaacttcacacaaagaactccagttgccatggccatgtggagcctctcctgcttccttgttagcgcatctaccagcccatgggtttctgcgatccttccacatgtcatcagcaggatgggcaagctggaactaatggatgtgaaccttttctgcctggttgccacagacttctacagacaccagatagaggaggaattcgaccgcagggctttccagtctgtgtttgaggaggaggcggcaccaggaagtccataccacaggctgcttgcttgtttgcaaaatgttcacaaggtcaccacctgctgagtagtgcctgtgggacaaaaggctgaaagaaggcagctgctggggcctgagctccaggagcctgctcaagcttctgctggggctgccttggccgtgcaggcttccacttgtgtcaagtggacagccaggcaatggcaggagtgctttgcaatgagggctatgcagggaacatgcactatgttggggttgagcctagtgctaggttgaccaggtgtttgtctttttcctagtgttcccctggccatagtcgccaggttgcagctgccctggtatgtggatcagaagtcctagctcttgccagatggttctgagcccgcctgctccactgggctggagagctccctcccacatttacccagtaggcatacctgccacaccagtgtctggacacaaaatgaatggtgtgtgggggctgggaactggggctgccaggtgtccagcaccattttcctttctgtgttttcttctcaggagttaaaatttaattatatcagtaaagagattaattttaatgt

SEQ ID NO: 9 - DNA, 8552 bp, Mus musculus
  misc_feature 3103: n is a, c, g, or t
ggttccgcttctgcctgccgcgcagagccccattcattgccttgctgctaagtggcgccgcgtagtgccagtaggctccaagtcttcagggtctgtcccatcgggcagtaagccgtcatgggaaccctggaaaagctgatgaaggctttcgagtcgctcaagtcgtttcagcagcaacagcagcagcagccaccgccgcaggcgccgccaccgccgccgccgcctccgcctcaaccccctcagccgccgcctcaggggcagccgccgccgccaccaccgccgctgccaggtccggcagaggaaccgctgcaccgaccaaagaaggaactctcagccaccaagaaagaccgtgtgaatcattgtctaacaatatgtgaaaacattgtggcacagtctctcagaaattctccagaatttcagaaactcttgggcatcgctatggaactgtttctgctgtgcagtaacgatgcggagtcagatgtcagaatggtggctgatgagtgcctcaacaaagtcatcaaagctttgttggattctaatcttccaaggctacagttagaactctataaggaaattaaaaagaatggcgctcctcgaagtttgcgtgctgccctgtggaggtttgctgagctggctcacctggttcgacctcagaagtgcaggccttacctggtgaatcttcttccatgcctgacccgaacaagcaaaagaccggaggaatcagttcaggagaccttggctgcagctgttcctaaaattatggcttcttttggcaatttcgcaaatgacaatgaaattaaggttctgttgaaagctttcatagcaaatctgaagtcaagctctcccaccgtgcggcggacagcagccggctcagccgtgagcatctgccaacattctaggaggacacagtacttctacaactggctccttaatgtcctcctaggtctgctggttcccatggaagaagagcactccactctcctgatcctcggtgtgttgctcacattgaggtgtctagtgcccttgctccagcagcaggtcaaggacacaagtctaaaaggcagctttggggtgacacggaaagaaatggaagtctctccttctacagagcagcttgtccaggtttatgaactgactttgcatcatactcagcaccaagaccacaatgtggtgacaggggcactggagctcctgcagcagctcttccgtacccctccacctgaactcctgcaagcactgaccacaccaggagggcttgggcagctcactctggttcaagaagaggcccggggccgaggccgcagcgggagcatcgtggagcttttagctggagggggttcctcgtgcagccctgtcctctcaagaaagcagaaaggcaaagtgctcttaggagaggaagaagccttggaagatgactcggagtccaggtcagatgtcagcagctcagcctttgcagcctctgtgaagagtgagattggtggagagctcgctgcttcttcaggtgtttccactcctggttctgttggtcacgacatcatcactgagcagcctagatcccagcacacacttcaagcagactctgtggatttgtccggctgtgacctgaccagtgctgctactgatggggatgaggaggacatcttgagccacagctccagccagttcagtgctgtcccacccgaccctcccatggacctgaatgatgggacccagccctcctcacccatcagtgacagttctcagaccaccactgaaggacctgattcagctgtgactccttcggacagttctgaaattgtgttagatggtgccgatagccagtatttaggcatgcagataggacagccacaggaggacgatgaggagggagctgcaggtgttctttctggtgaagtctcagatgttttcagaaactcttctctggcccttcaacagacacacttgttggaaagaatgggccatagcaggcagccttccgacagcagtatagataagtatgtaacaagagatgaggttgctgaagccagtgatccagaaagcaagccttgccgaatcaaaggtgacataggacagcctaatgatgatgattctgctcctctggtacattgtgtccgtcttttatctgcttcctttttgttaactggtgaaaagaaagcactggttccagacagagacgtgagagtcagtgtgaaggccctggccctcagctgcattggtgcggctgtggcccttcatccagagtcgttcttcagcagactgtacaaagtacctcttaataccacggaaagtactgaggaacagtatgtttctgacatcttgaactacatcgatcatggagacccacaggtccgaggagctactgccattctctgtgggacccttgtctactccatcctcagtaggtcccgtctccgtgttggtgactggctgggcaacatcagaaccctgacaggaaatacattttctctggtggactgcattcctttactgcagaaaacgttgaaggatgaatcttctgttacttgcaagttggcttgtacagctgtgaggcactgtgtcctgagtctttgcagcagcagctacagtgacttgggattacaactgcttattgatatgctgcctctgaagaacagctcctactggctggtgaggaccgaactgctggacactctggcagagattgacttcaggctcgtgagttttttggaggcaaaagcagaaagtttacaccgaggggctcatcattatacagggtttctaaaactacaagaacgagtactcaataatgtggtcatttatttgcttggagatgaagaccccagggttcgacatgttgctgcaacatcattaacaaggcttgtcccaaagctgttttacaagtgtgaccaaggacaagctgatccagttgtggctgtagcgagggatcagagcagtgtctacctgaagctcctcatgcatgagacccagccaccatcacacttttctgtcagcaccatcaccagaatctatagaggctatagcttactgccaagaataacagatgtcaccatggaaaacaatctctcaagagttgttgccgcagtttctcatgaactcattacgncaacaacacgggcactcacatttggatgctgtgaagccttgtgtcttctctcagcagcctttccagtttgcacttggagtttaggatggcactgtggagtgcccccactgagtgcctctgatgagtccaggaagagctgcactgttgggatggcctccatgattctcaccttgctttcatcagcttggttcccactggatctctcagcccatcaggatgccttgattttggctggaaacttgctagcagcgagtgcccccaagtctctgagaagttcatggacctctgaagaagaagccaactcagcagccaccagacaggaggaaatctgccctgctctgggggatcggactctagtgcccttggtggagcagcttttctcccacctgctgaaggtgatcaatatctgtgctcatgtcttggacgatgtgactcctggaccagcaatcaaggcagccttgccttctctaacaaaccccccttctctaagtcctattcgacggaaagggaaggagaaagaacctggagaacaagcttctactccaatgagtcccaagaaagttggtgaggccagtgcagcctctcgacaatcagacacctcaggacctgtcacagcaagtaaatcatcctcactggggagtttctaccatctcccctcctacctcaaactgcatgatgtcctgaaagccactcacgccaactataaggtcaccttagatcttcagaacagcaatgaaaagtttggggggttcctgcgctctgccttggacgtcctttctcagattctagagctggcgacactgcaggacattggaaagtgtgttgaagaggtccttggatacctgaaatcctgctttagtcgagaaccaatgatggcaactgtctgtgtgcagcagctattgaagactctctttgggacgaacttagcctcacagtttgatggcttatcttccaaccccagcaagtctcagtgccgagctcagcgccttggctcttcaagtgtgaggcccggcttatatcactactgcttcatggcaccatacacgcacttcacacaggccttggctgacgcaagcctgaggaacatggtgcaggcggagcaggagcgtgatgcctcggggtggtttgatgtactccagaaagtgtctgcccaattgaagacgaccctaacaagcgtcacaaagaaccgtgcagataagaatgctattcataatcacattaggttatttgagcctcttgttataaaagcattgaagcagtacaccacgacaacatctgtacaattgcagaagcaggttttggatttgctggcacagctggttcagctacgggtcaattactgtctactggattcagaccaggtgttcatcgggtttgtgctgaagcagtttgagtacattgaagtgggccagttcagggaatcagaggcaattattccaaatatatttttcttcctggtattactgtcttatgagcgctaccattcaaaacagatcattggaattcctaaaatcatccagctgtgtgatggcatcatggccagtggaaggaaggccgttacacatgctatacctgcaaatttacagagcagcatggcccagttgccagaggaggaactaaacagaatccaagaacacctccagaacagtgggcttgcacaaagacaccaaaggctctattcactgctggacagattccgactctctactgtgcaggactcacttagccccttgcccccagtcacttcccacccactgggtggggatgggcacacatctctggaaacagtgagtccagacaaagactggtacctccagcttgtcagatcccagtgttggaccagatcagattctgcactgctggaaggtgcagagctggtcaaccgtatccctgctgaagatatgaatgacttcatgatgagctcggagttcaacctaagccttttggctccctgtttaagccttggcatgagcgagattgctaatggccaaaagagtcccctctttgaagcagcccgtggggtgattctgaaccgggtgaccagtgttgttcagcagcttcctgctgtccatcaagtcttccagcccttcctgcctatagagcccacggcctactggaacaagttgaatgatctgcttggtgataccacatcataccagtctctgaccatacttgcccgtgccctggcacagtacctggtggtgctctccaaagtgcctgctcatttgcaccttcctcctgagaaggagggggacacggtgaagtttgtggtaatgacagttgaggccctgtcatggcatttgatccatgagcagatcccactgagtctggacctccaagccgggctagactgctgctgcctggcactacaggtgcctggcctctggggggtgctgtcctccccagagtacgtgactcatgcctgctccctcatccattgtgtgcgattcatcctggaagccattgcagtacaacctggagaccagcttctcggtcctgaaagcaggtcacatactccaagagctgtcagaaaggaggaagtagactcagatatacaaaacctcagtcatgtcacttcggcctgcgagatggtggcagacatggtggaatccctgcagtcagtgctggccttgggccacaagaggaacagcaccctgccttcatttctcacagctgtgctgaagaacattgttatcagtctggcccgactccccctagttaacagctatactcgtgtgcctcctctggtatggaaactcgggtggtcacccaagcctggaggggattttgggacagtgtttcctgagatccctgtagagttcctccaggagaaggagatcctcaaggagttcatctaccgcatcaacaccctagggtggaccaatcgtacccagttcgaagaaacttgggccaccctccttggtgtcctggtgactcagcccctggtgatggaacaggaagagagcccaccagaggaagacacagaaagaacccagatccatgtcctggctgtgcaggccatcacctctctagtgctcagtgcaatgaccgtgcctgtggctggcaatccagctgtaagctgcttggagcaacagccccggaacaagccactgaaggctctcgataccagatttggaagaaagctgagcatgatcagagggattgtagaacaagaaatccaagagatggtttcccagagagagaatactgccactcaccattctcaccaggcgtgggatcctgtcccttctctgttaccagctactacaggtgctcttatcaaccatgacaagctgctgctgcagatcaacccagagcgggagccaggcaacatgagctacaagctgggccaggtgtccatacactccgtgtggctgggaaataacatcacacccctgagagaggaggaatgggatgaggaagaagaggaagaaagtgatgtccctgcaccaacgtcaccacctgtgtctccagtcaattccagaaaacaccgtgccggggttgatattcactcctgttcgcagtttctgcttgaattgtacagccgatggatcctgccatccagtgcagccagaaggacccccgtcatcctgatcagtgaagtggttcgatctcttcttgtagtgtcagacttattcaccgaacgtacccagtttgaaatgatgtatctgacgctgacagaactacggagagtgcacccttcagaagatgagatcctcattcagtacctggtgcctgccacctgtaaggcagctgctgtccttggaatggacaaaactgtggcagagccagtcagccgcctactggagagcacactgaggagcagccacctgcccagccagatcggagccctgcacggcatcctctatgtgttggagtgtgacctcttggatgacactgcaaagcagctcattccagttgttagtgactatctgctgtccaacctcaaaggaatagcccactgcgtgaacattcacagccagcagcatgtgctggtaatgtgtgccactgctttctacctgatggaaaactaccctctggatgtgggaccagaattttcagcatctgtgatacagatgtgtggagtaatgctgtctggaagtgaggagtccaccccctccatcatttaccactgtgccctccggggtctggagcggctcctgctgtctgtgcagctatctcgtctagacacagagtccctgggcaagctaagtgtgggcagagtgaatgtacacagcccacacagggccatggcagccctaggcctgatgctcacctgcatgtacacaggaaaggagaaagccagtccaggcagaacttctgaccccagccctgctacacctgacagcgagtctgtgattgtagctatggagcgagtgtctgttctctttgataggatccgcaagggatttccctgtgaagccagggttgtggcaaggatcctgcctcagttcctagatgacttctttccacctcaagatgtcatgaacaaagtcattggagagttcctgtccaatcagcagccatacccacagttcatggccactgtagtttacaaggtttttcagactctgcacagtgctgggcagtcatccatggtccgggactgggtcatgctgtccctgtccaacttcacacaaagaactccagttgccatggccatgtggagcctctcctgcttccttgttagcgcatctaccagcccatgggtttctgcgatccttccacatgtcatcagcaggatgggcaagctggaactaatggatgtgaaccttttctgcctggttgccacagacttctacagacaccagatagaggaggaattcgaccgcagggctttccagtctgtgtttgaggaggaggcggcaccaggaagtccataccacaggctgcttgcttgtttgcaaaatgttcacaaggtcaccacctgctgagtagtgcctgtgggacaaaaggctgaaagaaggcagctgctggggcctgagctccaggagcctgctcaagcttctgctggggctgccttggccgtgcaggcttccacttgtgtcaagtggacagccaggcaatggcaggagtgctttgcaatgagggctatgcagggaacatgcactatgttggggttgagcctagtgctaggttgaccaggtgtttgtctttttcctagtgttcccctggccatagtcgccaggttgcagctgccctggtatgtggatcagaagtcctagctcttgccagatggttctgagcccgcctgctccactgggctggagagctccctcccacatttacccagtaggcatacctgccacaccagtgtctggacacaaaatgaatggtgtgtgggggctgggaactggggctgccaggtgtccagcaccattttcctttctgtgttttcttctcaggagttaaaatttaattatatcagtaaagagattaattttaatgt

SEQ ID NO: 10 - DNA, 10081 bp, Mus musculus
gcactcgccgcgagggttgccgggacgggcccaagatggctgagcgccttggttccgcttctgcctgccgcgcagagccccattcattgccttgctgctaagtggcgccgcgtagtgccagtaggctccaagtcttcagggtctgtcccatcgggcaggaagccgtcatggcaaccctggaaaagctgatgaaggctttcgagtcgctcaagtcgtttcagcagcaacagcagcagcagccaccgccgcaggcgccgccgccaccgccgccgccgcctccgcctcaaccccctcagccgccgcctcaggggcagccgccgccgccaccaccgccgctgccaggtccggcagaggaaccgctgcaccgaccaaagaaggaactctcagccaccaagaaagaccgtgtgaatcattgtctaacaatatgtgaaaacattgtggcacagtctctcagaaattctccagaatttcagaaactcttgggcatcgctatggaactgtttctgctgtgcagtgacgatgcggagtcagatgtcagaatggtggctgatgagtgcctcaacaaagtcatcaaagctttgatggattctaatcttccaaggctacagttagaactctataaggaaattaaaaagaatggtgctcctcgaagtttgcgtgctgccctgtggaggtttgctgagctggctcacctggttcgacctcagaagtgcaggccttacctggtgaatcttcttccatgcctgacccgaacaagcaaaagaccggaggaatcagttcaggagaccttggctgcagctgttcctaaaattatggcttcttttggcaatttcgcaaatgacaatgaaattaaggttctgttgaaagctttcatagcaaatctgaagtcaagctctcccaccgtgcggcggacagcagccggctcagccgtgagcatctgccaacattctaggaggacacagtacttctacaactggctccttaatgtcctcctaggtctgctggttcccatggaagaagagcactccactctcctgatcctcggtgtgttgctcacattgaggtgtctagtgcccttgctccagcagcaggtcaaggacacaagtctaaaaggcagctttggggtgacacggaaagaaatggaagtctctccttctacagagcagcttgtccaggtttatgaactgactttgcatcatactcagcaccaagaccacaatgtggtgacaggggcactggagctcctgcagcagctcttccgtacccctccacctgaactcctgcaagcactgaccacaccaggagggcttgggcagctcactctggttcaagaagaggcccggggccgaggccgcagcgggagcatcgtggagcttttagctggagggggttcctcgtgcagccctgtcctctcaagaaagcagaaaggcaaagtgctcttaggagaggaagaagccttggaagatgactcggagtccaggtcagatgtcagcagctcagcctttgcagcctctgtgaagagtgagattggtggagagctcgctgcttcttcaggtgtttccactcctggttctgttggtcacgacatcatcactgagcagcctagatcccagcacacacttcaagcagactctgtggatttgtccggctgtgacctgaccagtgctgctactgatggggatgaggaggacatcttgagccacagctccagccagttcagtgctgtcccatccgaccctgccatggacctgaatgatgggacccaggcctcctcacccatcagtgacagttctcagaccaccactgaaggacctgattcagctgtgactccttcggacagttctgaaattgtgttagatggtgccgatagccagtatttaggcatgcagataggacagccacaggaggacgatgaggagggagctgcaggtgttctttctggtgaagtctcagatgttttcagaaactcttctctggcccttcaacaggcacacttgttggaaagaatgggccatagcaggcagccttccgacagcagtatagataagtatgtaacaagagatgaggttgctgaagccagtgatccagaaagcaagccttgccgaatcaaaggtgacataggacagcctaatgatgatgattctgctcctctggtacattgtgtccgtcttttatctgcttcctttttgttaactggtgaaaagaaagcactggttccagacagagacgtgagagtcagtgtgaaggccctggccctcagctgcattggtgcggctgtggcccttcatccagagtcgttcttcagcagactgtacaaagtacctcttaataccacggaaagtactgaggaacagtatgtttctgacatcttgaactacatcgatcatggagacccacaggtccgaggagctactgccattctctgtgggacccttgtctactccatcctcagtaggtcccgtctccgtgttggtgactggctgggcaacatcagaaccctgacaggaaatacattttctctggtggactgcattcctttactgcagaaaacgttgaaggatgaatcttctgttacttgcaagttggcttgtacagctgtgaggcactgtgtcctgagtctttgcagcagcagctacagtgacttgggattacaactgcttattgatatgctgcctctgaagaacagctcctactggctggtgaggaccgaactgctggacactctggcagagattgacttcaggctcgtgagttttttggaggcaaaagcagaaagtttacaccgaggggctcatcattatacagggtttctaaaactacaagaacgagtactcaataatgtggtcatttatttgcttggagatgaagaccccagggttcgacatgttgctgcaacatcattaacaaggcttgtcccaaagctgttttacaagtgtgaccaaggacaagctgatccagttgtggctgtagcgagggatcagagcagtgtctacctgaagctcctcatgcatgagacccagccaccatcacacttttctgtcagcaccatcaccagaatctatagaggctatagcttactgccaagtataacagatgtcaccatggaaaacaatctctcaagagttgttgccgcagtttctcatgaactcattacgtcaacaacacgggcactcacatttggatgctgtgaagccttgtgtcttctctcagcagcctttccagtttgcacttggagtttaggatggcactgtggagtgcccccactgagtgcctctgatgagtccaggaagagctgcactgttgggatggcctccatgattctcaccttgctttcatcagcttggttcccactggatctctcagcccatcaggatgccttgattttggctggaaacttgctagcagcgagtgcccccaagtctctgagaagttcatggacctctgaagaagaagccaactcagcagccaccagacaggaggaaatctggcctgctctgggggatcggactctagtgcccttggtggagcagcttttctcccacctgctgaaggtgatcaatatctgtgctcatgtcttggacgatgtgactcctggaccagcaatcaaggcagccttgccttctctaacaaaccccccttctctaagtcctattcgacggaaagggaaggagaaagaacctggagaacaagcttctactccaatgagtcccaagaaagttggtgaggccagtgcagcctctcgacaatcagacacctcaggacctgtcacagcaagtaaatcatcctcactggggagtttctaccatctcccctcctacctcaaactgcatgatgtcctgaaagccactcacgccaactataaggtcaccttagatcttcagaacagcactgaaaagtttggggggttcctgcgctctgccttggacgtcctttctcagattctagagctggcgacactgcaggacattggaaagtgtgttgaagaggtccttggatacctgaaatcctgctttagtcgagaaccaatgatggcaactgtctgtgtgcagcagctattgaagactctctttgggacaaacttagcctcacagtttgatggcttatcttccaaccccagcaagtctcagtgccgagctcagcgccttggctcttcaagtgtgaggcccggcttatatcactactgcttcatggcaccatacacgcacttcacacaggccttggctgacgcaagcctgaggaacatggtgcaggcggagcaggagcgtgatgcctcggggtggtttgatgtactccagaaagtgtctgcccaattgaagacgaacctaacaagcgtcacaaagaaccgtgcagataagaatgctattcataatcacattaggttatttgagcctcttgttataaaagcattgaagcagtacaccacgacaacatctgtacaattgcagaagcaggttttggatttgctggcacagctggttcagctacgggtcaattactgtctactggattcagaccaggtgttcatcgggtttgtgctgaagcagtttgagtacattgaagtgggccagttcagggaatcagaggcaattattccaaatatatttttcttcctggtattactgtcttatgagcgctaccattcaaaacagatcattggaattcctaaaatcatccagctgtgtgatggcatcatggccagtggaaggaaggccgttacacatgctatacctgctctgcagcccattgtccatgacctctttgtgttacgaggaacaaataaagctgatgcagggaaagagcttgagacacagaaggaggtggtggtctccatgctgttacgactcatccagtaccatcaggtgctggagatgttcatccttgtcctgcagcagtgccacaaggagaatgaggacaagtggaaacggctctctcggcaggtcgcagacatcatcctgcccatgttggccaagcagcagatgcatattgactctcatgaagcccttggagtgttaaataccttgtttgagattttggctccttcctccctacgtcctgtggacatgcttttgcggagtatgttcatcactccaagcacaatggcatctgtaagcactgtgcagctgtggatatctggaatcctcgccattctgagggttctcatttcccagtcaaccgaggacattgttctttgtcgtattcaggagctctccttctctccacacttgctctcctgtccagtgattaacaggttaaggggtggaggcggtaatgtaacactaggagaatgcagcgaagggaaacaaaagagtttgccagaagatacattctcaaggtttcttttacagctggttggtattcttctagaagacatcgttacaaaacagctcaaagtggacatgagtgaacagcagcatacgttctactgccaagagctaggcacactgctcatgtgtctgatccacatattcaaatctggaatgttccggagaatcacagcagctgccactagactcttcaccagtgatggctgtgaaggcagcttctatactctagagagcctgaatgcacgggtccgatccatggtgcccacgcacccagccctggtactgctctggtgtcagatcctacttctcatcaaccacactgaccaccggtggtgggcagaggtgcagcagacacccaagagacacagtctgtcctgcacgaagtcacttaacccccagaagtctggcgaagaggaggattctggctcggcagctcagctgggaatgtgcaatagagaaatagtgcgaagaggggcccttattctcttctgtgattatgtctgtcagaatctccatgactcagaacacttaacatggctcattgtgaatcacattcaagatctgatcagcttgtctcatgagcctccagtacaagactttattagtgccattcatcgtaattctgcagctagtggtctttttatccaggcaattcagtctcgctgtgaaaatctttcaacgccaaccactctgaagaaaacacttcagtgcttggaaggcatccatctcagccagtctggtgctgtgctcacactatatgtggacaggctcctgggcacccccttccgtgcgctggctcgcatggtcgacaccctggcctgtcgccgggtagaaatgcttttggctgcaaatttacagagcagcatggcccagttgccagaggaggaactaaacagaatccaagaacacctccagaacagtgggcttgcacaaagacaccaaaggctctattcactgctggacagattccgactctctactgtgcaggactcacttagccccttgcccccagtcacttcccacccactggatggggatgggcacacatctctggaaacagtgagtccagacaaagactggtacctccagcttgtcagatcccagtgttggaccagatcagattctgcactgctggaaggtgcagagctggtcaaccgtatccctgctgaagatatgaatgacttcatgatgagctcggagttcaacctaagccttttggctccctgtttaagccttggcatgagcgagattgctaatggccaaaagagtcccctctttgaagcagcccgtggggtgattctgaaccgggtgaccagtgttgttcagcagcttcctgctgtccatcaagtcttccagcccttcctgcctatagagcccacggcctactggaacaagttgaatgatctgcttggtgataccacatcataccagtctctgaccatacttgcccgtgccctggcacagtacctggtggtgctctccaaagtgcctgctcatttgcaccttcctcctgagaaggagggggacacggtgaagtttgtggtaatgacagttgaggccctgtcatggcatttgatccatgagcagatcccactgagtctggacctccaagccgggctagactgctgctgcctggcactacaggtgcctggcctctggggggtgctgtcctccccagagtacgtgactcatgcctgctccctcatccattgtgtgcgattcatcctggaagccattgcagtacaacctggagaccagcttctcggtcctgaaagcaggtcacatactccaagagctgtcagaaaggaggaagtagactcagatatacaaaacctcagtcatgtcacttcggcctgcgagatggtggcagacatggtggaatccctgcagtcagtgctggccttgggccacaagaggaacagcaccctgccttcatttctcacagctgtgctgaagaacattgttatcagtctggcccgactccccctagttaacagctatactcgtgtgcctcctctggtatggaaactcgggtggtcacccaagcctggaggggattttggcacagtgtttcctgagatccctgtagagttcctccaggagaaggagatcctcaaggagttcatctaccgcatcaacaccctagggtggaccaatcgtacccagttcgaagaaacttgggccaccctccttggtgtcctggtgactcagcccctggtgatggaacaggaagagagcccaccagaggaagacacagaaagaacccagatccatgtcctggctgtgcaggccatcacctctctagtgctcagtgcaatgaccgtgcctgtggctggcaatccagctgtaagctgcttggagcaacagccccggaacaagccactgaaggctctcgataccagatttggaagaaagctgagcatgatcagagggattgtagaacaagaaatccaagagatggtttcccagagagagaatactgccactcaccattctcaccaggcgtgggatcctgtcccttctctgttaccagctactacaggtgctcttatcagccatgacaagctgctgctgcagatcaacccagagcgggagccaggcaacatgagctacaagctgggccaggtgtccatacactccgtgtggctgggaaataacatcacacccctgagagaggaggaatgggatgaggaagaagaggaagaaagtgatgtccctgcaccaacgtcaccacctgtgtctccagtcaattccagaaaacaccgtgccggggttgatattcactcctgttcgcagtttctgcttgaattgtacagccgatggatcctgccatccagtgcagccagaaggacccccgtcatcctgatcagtgaagtggttcgatctcttcttgtagtgtcagacttattcaccgaacgtacccagtttgaaatgatgtatctgacgctgacagaactacggagagtgcacccttcagaagatgagatcctcattcagtacctggtgcctgccacctgtaaggcagctgctgtccttggaatggacaaaactgtggcagagccagtcagccgcctactggagagcacactgaggagcagccacctgcccagccagatcggagccctgcacggcatcctctatgtgttggagtgtgacctcttggatgacactgcaaagcagctcattccagttgttagtgactatctgctgtccaacctcaaaggaatagcccactgcgtgaacattcacagccagcagcatgtgctggtaatgtgtgccactgctttctacctgatggaaaactaccctctggatgtgggaccagaattttcagcatctgtgatacagatgtgtggagtaatgctgtctggaagtgaggagtccaccccctccatcatttaccactgtgccctccggggtctggagcggctcctgctgtctgagcagctatctcggctagacacagagtccttggtcaagctaagtgtggacagagtgaatgtacaaagcccacacagggccatggcagccctaggcctgatgctcacctgcatgtacacaggaaaggaaaaagccagtccaggcagagcttctgaccccagccctgctacacctgacagcgagtctgtgattgtagctatggagcgagtgtctgttctctttgataggatccgcaagggatttccctgtgaagccagggttgtggcaaggatcctgcctcagttcctagatgacttctttccacctcaagatgtcatgaacaaagtcattggagagttcctgtccaatcagcagccatacccacagttcatggccactgtagtttacaaggtttttcagactctgcacagtgctgggcagtcatccatggtccgggactgggtcatgctgtccctgtccaacttcacacaaagaactccagttgccatggccatgtggagcctctcctgcttccttgttagcgcatctaccagcccatgggtttctgcgatccttccacatgtcatcagcaggatgggcaaactggaacaggtggatgtgaaccttttctgcctggttgccacagacttctacagacaccagatagaggaggaattcgaccgcagggctttccagtctgtgtttgaggtggtggctgcaccaggaagtccataccacaggctgcttgcttgtttgcaaaatgttcacaaggtcaccacctgctgagtagtgcctgtgggacaaaaggctgaaagaaggcagctgctggggcctgagcctccaggagcctgctccaagcttctgctggggctgccttggccgtgcaggcttccacttgtgtcaagtggacagccaggcaatggcaggagtgctttgcaatgagggctatgcagggaacatgcactatgttggggttgagcctgagtcctgggtcctggcctcgctgcagctggtgacagtgctaggttgaccaggtgtttgtctttttcctagtgttcccctggccatagtcgccaggttgcagctgccctggtatgtggatcagaagtcctagctcttgccagatggttctgagcccgcctgctccactgggctggagagctccctcccacatttacccagtaggcatacctgccacaccagtgtctggacacaaaatgaatggtgtgtggggctgggaactggggctgccaggtgtccagcaccattttcctttctgtgttttcttctcaggagttaaaatttaattatatcagtaaagagattaattttaatgt

SEQ ID NO: 11 - DNA, 154001 bp, Mus musculus
gggcatttgattcttacaggtagcctgaagcttcattgggtttctcactgcatggatcacctccagacagctttttctgaagccggaacggttttgtttgtttgtttgagacagggtttctatgtagctctggctgtcctggaactcactttgtagaacaggctgacctataactcagagatctgcctgcctctgcctccagactgctgagattaaaggtgtgttctatcactgcttggctttttccttttcctttttcttttgagacaagttctgatacagcccatgctgacttgaattcactatgaagccaaggaaaacctggaactcctgatcctcgttctacctgcagagtacatgattaccacccctggtttataaaatgcagggattgaactcagagcttcgtgcatgctactcaaaaagcattctacaagtgctgtgattaaaggcatgcaccaccatgcccggttgaagccaacactttttgctgggcagactgcaggggcagcttgggtgtatccacaccattttcagcttcctgctttaattgctcacctttgggagatggaggctctagagacaaggacttcagcgctggtggcaatgagaccccttgtaggtcctggctggttgccacagcactttccagggtccgtgtctcaatgtagagtgtgtgaccaaagttgcatgaaacacagcctttctttggacagtaactactgctgcctgcctgaaaccctttctcagccttcgctgcctgcttgaaaccctttctcagccttctctactgcagacacttctggggcttcggggtccacggatcataaagggttctttggtcctgaatacaggtcactctggttcccttctcattgcagggagctcccagcacgctgcgttcgggaagctcaggccaccacctggcttgtggaagagagagctgctttgggtttcgggttccgagctccacaatcgctttcccggtgactccaggtgtagggtggctttacgcaggaaaatttcttcgctgtcattcccctttccaaccttttcttccttccgggtctccccaactcctctgcccacctcctcacttcttttctatcgctggtgccagggagccgccctaaagcccactctccgctcagctccgtccctcatctagcagcccgccccgcccacctcatcctcttgcttggccctcttcactaaggggggctggcttttgcgggaaggggcggggccacatcggcggggcggagagtcttaaactagcagaggccccgcaggcctgcgtcctgacttcgggaaagaggacgacgcatccgcctgtcaattctgcgggtctggcgtggcctcgtctccgccggcatgacgtcacgggacgcactcgccgcgagggttgccgggacgggcccaagatggctgagcgccttggttccgcttctgcctgccgcgcagagccccattcattgccttgctgctaagtggcgccgcgtagtgccagtaggctccaagtcttcagggtctgtcccatcgggcaggaagccgtcatggcaaccctggaaaagctgatgaaggctttcgagtcgctcaagtcgtttcagcagcaacagcagcagcagccaccgccgcaggcgccgccgccaccgccgccgccgcctccgcctcaaccccctcagccgccgcctcaggggcagccgccgccgccaccaccgccgctgccaggtccggcagaggaaccgctgcaccgaccgtgagtccgggcgccgcagctcccgcccgggccccgcgcccctggcctgcgtgctgggcatggccaacactgttccctgtccagagggtcgcggtacctccctgaggccaggctttcccggcccgggccctcgtcttgcggggtctctggcctccctcagaggagacagagccgggtcaggccagccagggactcgctgaggggcgtcacgactccagtgccttcgccgttcccagtttgcgaagttagggaacgaacttgtttctctcttctggagaaactggggcggtggcgcacatgactgttgtgaagagaacttggagaggcagagatctctagggttacctcctcatcaggcctaagagctgggagtgcaggacagcgtgagagatgtgcgggtagtggatgacataatgcttttaggaggtctcggcgggagtgctgagggcgggggagtgtgaacgcatccaatgggatattctttttccaagtgacacttgaagcagcctgtgactcgaggcacttcgtactctcctggcgtttcatttagtttgtggtgtagtgtagttaaaccaggttttaagcatagccagagaggtgtgcttctgtgtgtctgcaggcagttggatgagttgtatttgtcaagtacatggtgagttacttaggtgtgattattaataaaaaactatatgtgtgcatatatatgaaagagtcgacttatacttaactgcctatcgattttttgttctatataaaacggatacattggtggtgctcagttttcaccggggaatgaattttactagtgttgcagacaggcttgttttagaacataggccactctgactctgactttgtgccagtaaaagttcctgtttagttctttgctgacatcttatagatctttggaagctagctgcttgtgactggagagaatattgaaacagaagagagaccatgagtcacagtgctctaagagaaaagagacgctcaaaacatttcctggaaatccatgctgagtgttgagccctgtgctctcttgcagctcagtcctttctctcaactctgggcattttatttctaatctggatttgtataattaataaggagaacttttgggaacaacctactaaagaatgtcatcattaaaactcacttagaaaataagtgttctggtgatatcattgagctatgttcccagtcctgagagtttgtttttttttttttttttaaataaagatttggggagaaaaggtggcttacttgatagaacaaaatataggaataaaatttccttctataaggtgaaaagtgtgaatagaaaacttcttatcctctagataagtagtttctttttgcttttgagagtctcactatgtaactcttgacctgaactcagagagatccatcctcctgcctctgcctcctctctctgggattaaaggcatgtggcaccatgctgggctgtccaagtatgccacagaccctctaggtccctggtcttcgaggaacgggatttcttaggcagatgggtaaggagtcggatgaaaatgacaatcagccacacacaagagaggtgttgaatctgaatgtaatgttctggttgagcttcagacttatataacaacgaattatcagaggatacaaatcacaaaaagacaagatacactgaaattcaccagttacagcagaaaggaatttgcagggactaattaaatgtttacattagggataacaagccctgcctaggatcagcctaatgccaggcaagaatttcacactttaaggttaaaagcatcagggggttgttaactcttgacaggccttaagagtaatgtgctatcactgagctctaaattcttaggtctagtaaaacttatcctgtctggagagttcccccttatcagggtagtatatcaacttatacttgacatggaatgaagcctgtagtaaaacatttctatctcagtgagacttttagtctctatctgtaaacagctgagtaaaatggcaagtgcttaattgtttactgaatgggttaagctccttgctgctatctggaatctaagaacactggggaaaggctttagctatgttagaatacaatattaaaaggcatttactataaggtgatgcttaatagagtgcacgtgaatctatacactagattaatgtggtggaaatttgaatataatgggttagggaaagagatgccataactctgggaggaaaatttccctggactcttatcctcgtgaaacagcttccaggcttttcgcctgacaaaccgatccaaactggagagttggctttcgccagaatatccaggaggagagtcctagaaattcatttctcatgagcagctttttggcatttttgcctcacaagctgactccaccagagtaccctgacacaagtattgtctagttattttgattattaccatgactctgcctctgggtgagaggaattgtggaagtttacatattccccatatcttctataaacctctgtgtgtgtgtgtgtgtgtgtgtgtgtgtgtgtgtgtgtgtgtatgagggagagagagggagagagagagagggagggaggaagagagagagagagattgttctgtgcctgcttcgaacacaaattagtttgcaaaagtaattcattaacatgatacagtcccaaagataaaaatggttaaataatgaaaacatctccctccccattttcctaactttgtacccaggagcaagctctgttacacttcatttgtccttccagataaaatttgggcatatgttaggacagaattttaaattatttacaaacaaaagtattttggaacaaaagcttttaaaagcttttattttaataaaataacttgttactacactgtatataactaactaacattttccaaaattagctccattagcatctatctcatatttctatgtactttgctgttgaaaaaccaagtgttcattaataataagtaacaaactcactgcttggaagctttgatttttggcattttgtccacttgactcagttaaaagtcctttttttcgaaatgagaacagccaaaacagttttagaatgagtctgttctgcttttgtgactctcattgtgttctgtagaaccagtgtcacagccatatgtgggcctctgttgaagtagctgagaacttgttctctgctctgctagctgctgtcgatctgataggccttgaacagttgacattcacccttaatagtcctcattagtcttcctgagcatagtcattcatttatcaatatttgctgatcatctcctatgtgcctagcattgttctagttgcaggttttagcagggaacaaagtcatgtctcatgaagctaaaattcttgggagagacatagacagtaagcagaatagtttgttcatagtgagtgatgaggcgcatgcagtaaagtagggaaggggattaggaaatgccagggcttgacatgttttagacagggtgtttaaataatatctgcttagttgaaggcttatttttgaataaatatctgaagagtcagaaatctaccaggagggtgtatggaagaggagtattcctgcaaggggaagttgtcaaaggctttcctgtgtggggattagtgatgtcatgtttttgctggatgaaatgagtgacggtaagagttgtagtgggggtgaagcaaagggttgagggaggcttcattggtgttatcagttactgcatttatctccaaatagagaacgtagcaatgaaagctacagagaacgggaaaggtgaggatttattctaagacaaaataagtgtaggaagtttaacaattagatcaggagcacagactccaagtctaagtcttcattcttgcacattttttaaaaattttgttatgtgttctggatactatttccttatgagatataagtttaaaagcctttctgtggattgccttgcctttgttgttgttgtttgttttgttttgttttgttgagacaggtctctctatgtagccttgactgtcctgaaaatcactctgtagaccaggctggcctggaactcagagatctgcctgcttctgcttttcaagtgctgatattaaatgtatgtgccaccactgccaggctaagattgttctttcaatttctttttttgttttcttttgagatcaaagtttgctatgtacttttggctggcctggtatattgtgtagtctaagttggcttcaaatcttcatggcacagattcccaagtactgggaccataggtatggcccatcacagtggggggttgggggggccagtacatctatctcttgaatggtgtggagtgtatatatgtgttaggggtttgcagaggccaaaagaatattgagtgtcttcctctattgctcgccacttctctgaataaacctaaagttaccaatggatttctagtaagctgactgaccagcaaatattggggatctgtctgtccctgttcaccatagtgaggttacagacgtgaataaccacacccagttttaacgctgaatgctgaagagttaaactcaggatttagacttgcctcactttcttatgttcttcaaagcatagacattttaagttttgatgaagtttaattttgtctttagctacggtatgttagatacttaataaatcactcttttatctgaaatcacaaagatttatttactccctctttttctaagagttgtttgtaagcctgactcattttgaatttgtggttaaggtagatgtctgactcttttcttttgcacgtgtaatttagcatttggctaaagagaatgtttttttctcattgaactgtattgacatctttgttgaaaattattacctgtccatatgtaaatgtttctacttccatttttgccattgattgtgtgtctgttctatgccagtactatacagtcttgattactggtttatatcatgatctcaaatcataaagtatgccccccaacattgtctttttcaatgttgctttagttattctgggtcccttgtgattctatccatcaatattggtgaacttcatgaccagatagtaaacggttaaggctctgtggctataatgccatcacagccagtcagctctgccactgtggcatgaaagcagccatagaaaatatgtaagagaatgagtacatagaattggaatttcttaaaattttcaagtcatgaaacattcttttattatttttttttaaagaaaatgttttatttattctttgacagtttcatgcatgtatacaatgtatctgaatctcatgcagggcccctactatctccctcccatctacacctcagcatgtccttctcccacagggtccctactctctccctcccatctatacctcagcatgtccttctcccacagggcccctactatctccctcccatctacacctcagcatgtccttctcccacagggcccctactatctccttcccatctacacctcagcatgtccttctcccacagggcccctactatctccctcccatctacacctcagcatgtccttctcccacagggcccctactatctccttcccatctacacctcagcatgtccttctcccacagggcccctactatctccctcccatctatacctcagcatgtccttctcccacagggcccctactatctccttcccatctatacctcagcatgtccttctcccacagggcccctactatctccctcccatctatacctcagcatgtccttctcccacctccatgcctttttttaatgacccactgaatccagttagtgttgcttgctggaatggaatgttgactggtttttgtttgtttgtttgtttttgtttgtttgtttgttttccctgaggcaggctttctctgtgtagccctggctgtcctggaactactagctctgtagatcaggctggcctcaaacacacagagatgagtgcttctgcctcccagtgtagggactaaaggtttatctcccacccagttcttgtgtggtaaccataactgcagtgagtttattattacagcagccatgccatgtctggaaggcagaatttcattgagctctataaaacctggctcataaattctctctaccccttcccttccctgaacctgggtgtgggggtcaatttagatgtcacatttaggctgacatttatcagtcacttattctcagtatactatgagtttttgagttgctgcccactgcagaaagaggtttctttggccaaggcctgacagtagcactagtctgtaggtataaatgtaaatatttactcttgtttgtttatttggttggtttgttttttgagactgggtttttctgtagcctggccatcctggaactcactttgtagaccaggctggtcttaaactcaggttcacttgcctctgcctcccaaatgctggaattaaaagcatgcaccaccacatcgggctcccaaacataaatatgtagaaggtagtctaacaacatgtctacttagcaaaacagcagtagtagggtcctgttttaggacctgtaacctccttcccctgagtcatgggcttttgactaggtgtgtacctttggcgcacactttaagtctagtcagaaaactgtgggttatctttgtattctttacatcactgttgcactagtggtcacatttcgcctttgtctatattatagcattcagggtccagtgcttagtaagaccattgatgtcttttctcctccagtggcctgcaaaacacctggcattataaaacctaaccagccaagaggaagttttcagatcagttctatcttgatttctctatgtcttctatgcaaccaaagtgtgttgtatcttcatcaatagggttttactattatatagttacattgggcaaccaagagtgatagaaataacctgtgttgtttggataggaaggtgtttctgggacctccatgactaataacttgtaagaggtatctcatgcttagcacatgttttctgaggatacattgtcatgtacatacctatgttgaaactcctttaaaaaacacttatacttttaaattagctttcaaaatagtttctataagtttttttaaaaaagattatatatatatatacacacacatatatgtatacacacacacacacacacacacacacacacacacacacacatatattgtagctgtcttcagacacatcagaagaaggcatcagattccattacagatggttgtgagccaccatgtggttgctgggaattgaactcaagacctctggaagagcaatcagtgctcttaacaattgagccatctctccagctctataagttttttttcacacatcatttacattctgtaagtaatgaataatcactacacaaaacaacaattgttctcctgaacattaattctggagaatctaaaattaacagtctcataaaacctgtatgcaaatgattaacagatctaggggtaatagcctcaagctggaatcagtttagaagtcgtcaataggtagttaagctacctaacaacaagaaggaattcagctgctgatacctgcagcagctcaggtaaatagtggagattataggccattgagcaagctgattcctaatgcctactcattatatgattttacttatgtatctttttttcctgtaatgttagatctttggttattttgttttccccttgtggcaaaataacatcacataaaacataaccattttgagtatacaatctatgattgtaaaaacacagtgttccattgtgaccaccagccaccactgttactcttcctttttaacattgcttttaaaagtatattacaaaaaaagtatattacaattttcacttgacattgtaattgtacatgtctatgaatagggtcatttttttaaaattatacattctagtatcttctgttgcattcagttaacttaagagcaggaaagactggtatagaagtccttttctctctctcttttttttctttttcgagacagggtttctctgtgtagccctggctgtcctggaactcactttgtaaaccaggttggcctcgaactcagaaatccgcctgcctctgcctcccgagtgctgggattaaaggtgtgcgccaccacacccggcgaagtccttttctatgatagagagtatatcgtgggcaaatcctaggccttggctctttagtcaaccagcatttgtatgattaaataaaacattggtgtgtgtttgtgtgtttgcacactgggtacagcctttcctttattagccctgggtgtgattttcttctctgctgatagatcctttctaagctgatcgcttcatacttagggtggggatagttgtgaggactgaggaggtgatgtgcggtcctgtccctttctcattttgctagtgtgactgatatgttagttctttgcatgtgtctcctactctggaaggagctggatgggaattgtttgttttttagtcactaaatctagactatcaggttcatggcaagttctcaggaagtacttattacatgtatagagttataatctgaacttgattagacatatggcacttttcatactcctacttttgtttttcaagttatttttttctacttaccagtttcatgttttaaaaacttgtttctttttttaaatttttttaattaggtattttcctcatttacatttccaatgctagcccaaaaatcccccataccctccaccccactcccctacccacccactcccacttcttggccctggcattcccctgtactggggcatataaagtttgcaagtccaatgggcctctctttccagtgatggctgactaggccatcttctgatacataagcaactagagacacgagctccagggggtactggttagttcatatcgttgttccacctatagggttgcagatccctttagctccttggatactttctctagcctcctccattgggggccctgtgatccatccaatagctgactgtgagcattcacttctatgtttgctaggccccggcatagtctcacaagagacagctatatcagggtcctttcagcaaaatcttgctagtgtatgcaatggtgtctgtatttggtggctgattatgggatggaacccctagatatggtagtctctagatggtccatccttttgtctcagctccaaactttgtctctgtaactccttccatgggtgttttgttcccaattctaagaaggggcaaagtgtccacaatttggtctttgttcttcttgagtttcatgtgctttgtatcttgtatcttgggtattctaagtttctgggctaatatccacttatcagtgagtacttgtttcttttaattaaaaaacaaaacaaaacaaacaaaaaactgtgtgtaggccgggcgtggtgcccctcatacttaatcccagcactcaggatctctgtgagtttgaggccagtctggtctacatggtgagttataggacatctagggcaacatagtcagaccctgtagtcaaaaagaaccaaaactgaaccaatacaaaactttgtgagctagtaaaatagtgaagtgcttgctaacattctgagtttgatctctgggacccatgtggtagaaagagaggaccagtttccacaagttgtcttttgatctccatgtgagtgccaaagcacacatacatgtattaaaatgtgcatgtgtaattgtaaagtttcgttaccactgacagtcagaaacgagctctggggcctcagggttctcttccttcagtgctgtgggaagtgcacctttaaacaatcttatttgggtttcttttggagacaggagttatgacagagattaaacttggctttgagcaaatttcatacacatttaaccactgaatttaaccacagtgcctattcagttttgaatatcacatgactagaatcgtagagctcctcctattcataactcacactgtgtcaaagctccttttcttcagtgttgttggtcacccatttagtttgtctgttttgtatgaatatgccctgtttttctcatcttattagtgcatgcttgggttattaaactttgacaaatgctgctgtgaggatatctcatatgctggcctgtcttttccctcacaaaatggtgctttttaatgagcagttcccattttggtgacttctaatttgtcatacttttccattatggtaagtgcttttatttcttttttgatgaatttttcatcaacttgagatcatgagacgtttcctgatactgttgcataaatggcatattgatttgcccaatgaagttgacttgtttttgtgtgtggtgtaaaatagacttcttgtttgttcttctaatgtgggtacttcttttttcaccagtttcctccatgttctgtgtgtatttcctcccttttattgttattaagtttatattattaaaagaattcacattaagtaggtttttttttaaaaaaaaaactttttattaattctttgtgagttttatatcatgtaccccactcatctccctgacccgtttcccccctctgcccttgcatcccccccttcaaaagaaaagaaaaaccacacaaacagaaaaaccaataatgtatagaaaacatctcatagtagaaactgtatcatgtcacagtgtgtgccactgtatacccctctgtctgcacatcttgacatgcagatgatcattgcaatgagtcactgatctgattcaaggtctctgacttatgtcacaccattaatattggatcttctccaggactcctcttggtttattcagttgttactctgtgtcatcaagttcctgcagctttggatcagcaggaccggctcttttatgtactccaacggttcacagatgatgtagatgttggggtgcgccaactcaaagccctggatctgggcctgggtggtagttgtgctggtcagcctgctggctctcctgcatctgcatcaccagggctgttctccagcactgctaggccactcgatgctatcatttgtaagaagcagggtcatgaggagggaggacacctccctgccccaaaacacacacacaccacccaatggcagatgagtgaccagtccagctctccctctatctcacccttgaggctaggtcacctgtgcacctgccaccagggccagctctactctgctgcccagttaagattcaggacctactctcctgagtactgctgctggtgagaggtgtgccagctctctagagtgccaaagccagttctgtacagatacatggctgcacagaccagggacatccccatggtttctagtgataatgtgagtcacgacatcaacatcaatccctgccactgcatggccacagatccagacatggtcctcagtagcagcaggagttggtacttcaccatggcttcaagtggcagggctagctactcacaataggctcttcctcttccccctcatgtctcagttccttctctcttcatactgcgcaggctgttctgcttctctttctcttccttctgtccaccacatacttgcacattgcagagactcctgctgcaggcaagccatgatgctggtatgcctctgggtgatctcctctgcttgtgctgtttggcatggtggcatgcagacctctaggtgtctacagctacccatgtgacatggcagcagtgtcctcccccacccctctctgcagtgtggcaggcaggtcttctggacttttttccctgccagtgccctgtgtcatggcagtgggatggcagtgggtgggtctctctctctctcttttttttaaacacagggtttctctttgtagccctggctgtcctggaactccctctgtagagcaggctggcctaaaactcacagagatctgcctgcctctgcctcccaagtgctgggattaaaggtatgtgccaccaccacaggcatggcaggttcttttggcataattatttctcactttgttctggggttgtttaggacagagttttgtgttgtagctcatgctggcctagagcatgctgtggttctcctatctctactccctgcattctaggagtgaagatgttcaccatgtttggttctagttatcttaaaataaggaccatctcttgctaataatacttttcattgtacagtacattatgccccggtctgtcttagtatttgaagaacctttgtccttcatactgattcttatgtctttcctagatggcatcttctgtctcccacatagacaatattgtcacatcgttgtccttagacaatattgtcatattgttgtcctttgctattggaagattgaagggttttgttgcttaaaagaccattttgatagtctaagtgttgctgcatgattttgtgtgtgtgaatatgtgtgtttaagtgtagtttttcagtattatcacttcttgagaaagtatatcctatagttccaaatcagatgttgatttaaccttttaaaaaaatctttctggtgctggagagatggttcagtgtttaagaacactaacttgctcttctagaggtcctgagtgtgattcccaggaaccacgtggtggctcacaaccatctgtaatgggatctgatgccctcttctggtgtgcctgaagacagctacagtgtactcatatacatttaaaaaaaaaaatctttctactcaggtggtggtggcagcacatacctttaaccccagcacttggggagcagaggcagctagatctctgtgagtttgaggctagcctggtctacagcgtttcaggacagccaggactacctgtctgtcttgaaacaagacaaaacaaaaacgccaaacctttctgaaagtggtctaagtgttcagcaacactgtcatgtaaggataggacttgacaaaaatcagagagcaactgttgaagaatcagaagctatgcattcatgctccaggctgctgtgcttcttataggcaggacagcttccagacttcagtcttgcccccagtatggagtgtacgttacatgtgttcgtggagggggaggaggaagaggaggggagaggaggaagaggaagaagaggaatgttttaaaattccttgagcggttcagtctaccctcttctcttaatgtggaatcacattgttaagatttttatttttaattaggtgtctatatatgtatctgtatggaagtctatatgcacatgagtgcatgtaccctgaagagggtattggatcctatgtttctggagttaaaggtggttgtgagccacctgatataggtcctgggtaactgaacttggagtttttttggattagcaataagcactcagaaccattgagccatctctccaagccctgtaatcacatatttaaaagaacaatgagtgtaattctaaagttaagaatttagatatgggggctggagagatggttcagtgattaagaacactgactgttcttccaaaggtcctgagttcaattctcagcaaccacatggtggctcacaaccatctgtaatgggatctgacaccctcttctggtgtgtctgaagacacctacagtgtactcatataaataaaataaataaatcttttaaaaaatgaatttaattatgaaggccaaatttatatttttagaagtagttcttaatttgttacagtgtgctctagagcctggattttacatgcccccacaattgtgagcctgtgtagattgctttgttgcacttaaaatagtttggctgaagcttgttttcattttgaagatgtagtttcaagtggttgaagagccaaggttgtttttaccctattgatacagttcctaccctgagctattttatttttcataaaaaacaaatcagtctgacttatctctaaaaatcccatctaatttcataaggaatgaaatagctacagatgtttatttatttattttatatcagattttcttattggacagaatgaggtagaaaaaaatgttatttcaggctgggacctaggctaggtgtggtggtgagggctgcagttctagcactaagagccagagatgaggcaggaggatcttgacttcttgagagggctagactgggttccaggccagccaggagtgagagaagaagaggggtgggtgctttacagaactcagctggaagatgtatgccaaacacctgcagctttatcatttctattctgtctctcctctttttaagctaaagtttaaagggctagagtcccctgcaggttggagaatctaaggaatgaagttgaaaggtagcctgaggtcaaattgatttgttgttttgagacaaagtcttgcactgtatattcaaggctcttgtcaaattcctgattctcctggttccgtctcttgaatgctgccaagttataatattgggatcgtgttctaattggctgagaagtctgtattagaagttctagcttctgacctgcagagtatagcagaaggattttcattttctgatatttttggttagtgtcatctctgttctgagagtgcattctgactctcatactttaaataagagtacttggtatgctaagaggaaatgcttgttataagactgtaaaactatcttttattctcctggagtaattgtctccaaggcttactgcctctgtccattaacctagacttagtacccaaaggtgctagcctccatacaatctaatttatgccgagactattttcaacttctgaaacttattgctccataagctcaccctttcttgttctttctgatctctggctgctgattcaattcagttagctgttctggctcagactcctctccaagctgactgattgaatctggtttctctctcttggcttctcctgcattgttctgcttggccttacactaactttgacaatctgttctaattttctggctccttcttattctctggcttgttctagcttcacctgtgtctagtttgtcctctctctataacctgtctctctatcacggtccagggaaaactgcctccttcctctctctgccctcctctgcaagtagctttttttccccctttttcttctggtgagagttgggcagatcctattctagcaaatctttctctaattcatcactttgtctgctattcaattagacttctataaactacttttaccctcattgattgagattaaagggtgtgtttgtattccagccagaagtggcttaggtgtatgctaagggcttagccacaccacaacgagaaataagttttgttgttgttgttggttttgttttttgttttttgtttttttgtcagtaaataacacaatcttagagttcattgtgtgatcaaatatcctgcaacataaggtctggatgttctggcctgaattttaaatctggcaccatgagagatagattctgatagaagagttgtgctgctcttagaatgtacagggccagagaacagatgcatgatggatataagaaaagaggaacaatatcattattgtaagagcaagtagatggcttgcttttcacacaaagcaggcacttaataactattgtttgaattttaagtcaaactagcaactattgggaactagcaaaattttatgatattaggaagggtcaaatttttcctgaaaagggtttagtttgttgtaaatagtttgggatgaggtaaaagagaaaacttgagatttgtcttttctttggttgtctgtgatggtttattgtcccgtttttgacagtgacctcttagtgatgtgaatctgtgaacaagtgatctttgcacgtgtatgtttgtatgtgtgtgtgctcatgtgagtgtacctgctgtgggcctgtggaagttagaggacaactttggagagttgcattgtttgtatttgtcagggttctctaaaggagctgaactgaaaagatgtatatgtgtgtgtgtatgtcttagttattgttctttagtgatgaaacactataaccaaggcaacttaaacagaagcatttaattggggcttgcttacagtttcagaggcttagttcttatcatcatggcaggattgtagagtcaggcagctatggtgctgagaagtagctgagaactcacatctgactagcagtttgcaggcagggagagaaagagagagagagaggcagagagagagagagacagagagagagagagagagtcagagacagacagagacagagacagacagagacacagagagagagacaaacatagaaagagatacagacagacaggtccattaactagaaccaaacatttaagcatgagtccatggggccattctcgttcaaactactatatatggtatataaaatgtgtatatatgtatatatacatatatatatatatatacacacacacacacatgtacatttttaaaagggaattttttatgttgctttataagttgtggtctgggtagtccaacagtgactttcctctgacagaaaggccaagaatccaacagttgttcaaattgaatgtctcggcagtcccagtctgttgctggagtcctggaagattcctagagaggtgtggggtctttagtctgtgttggagttctgaaaaagtaggttccaataccagtggaggaatccctcagcaacaggataaattagttctcaacatttggggggtccaacggccctttcacacgggtcacctaagaccattgaaaaacacagatatttatgtggtgattcataacagtagcaaaaattacagttatgaaatactgtacgatgagaataatgttatggttggggttcattatgacttgaggaagcttattaaaggatctcagcattaggatggttcgtaaccactgtgatagatggatcagctgtggagagtgagggcacgagggcaagcagcaaagtcttccttccatgtccatttatgtgagctgccaccagaaggtgacctagatttagggtgggtcttcccaccttcagtaatccaatcaagaaagtccctcacagatatgcccagtgcttgggttttagttgattccagatgatgtcagttaagattagctgtctccttggtcctttcctttctgctgttttcaacccctccctcctggctttgtccctctccactcccccatctagtcaagcaattttcttaccagactaaagaatttgagttcaggacattttagatgaagctttattatttctacctttctttgatctcttgattttagatacataagtgtaaagttaaagatcattgtcctttatcttcagagttgccgaagattcacccaagaaactagtactgataatttctgtaatgtattctcccatattgggaatttacttcatttgatgagctcttgtggaactctgtatagtatgggtactgagtgctagtaatatagataagatatggtcccttcaccttcacttctggggatacaatctaaggcacactgtctgaagaagtgccagcaggagccagagaagggcccttggtaaataagagcttcccccaaggtgcccagtgcctcaaaaagaattatgaattttcatttcattgttaagattggtattgtctataagtcatagtttgataagcttgactaagtcgaaggtggcaagccataagaggtggtatcatattctttgttgccacctttatcctatggggttatctcatgaaggagggagagcaagaatgaataccagagaaaactttttccaactcatttgtattacttcaaagatgtaagataaatgctccataggcctacctagtttatcagacatgtagttcgtgtgaaactgttgggtttttttttttttaatctttttttaacttgtggatgtgtgtggtgtttgtatggaggcagacatgtgtgtatggtgtgttttacagtatggaggcctctaagattgatgtcgggaatctcccttatctttttgtactttgttcttcgaggcaggatctcttagtcaaactcaggctttgatagccagctagctcaaggactcaagtcccatctctcctttcaatgctggattcacaagtggctgctgcattgtcactttgcatttaaatgggttttggggatctggatttggcccctttgtttgtacagcaaatgttaacactaagtcatcttttcaggtctgattttttttccccttaaattctttattaatagccacttcctccatgattctactaggtgatacaactccatcagtaatttttaactacagaaaagttggcatgttgacatactgcttctgtggacacatgcctcataaacttgtcaaagcccgaggggacgttgggaatctctttatgacaattcccgagggcagtagtctttcctcttgaaagtggatgaggcctagacctgtttatttgggcagccatataccactgatcatggtggacctgtcaaaagtacctatttaccatgctgtctgagtttagctgagtcttgtcagttacaattgggaaagttggcgagagcaaagggacttggttagtttggctttggatccgaggtgactgaaaatctcagataatgaatgtttccataataaatgtaattaggtcactgagttcagtgttgtcagccttctttttttgtttacactttttgctttattatttaatgaatgtattagtgctgtgctgcatgtacaccagcatgccagaaaagggcaacagatgccctttttgatggtcagagccaccatgtggttgctggcaattgaagggaattgaactcagaacctctggaagagcagctggtgtgcttaattgctgagccatctcatcaccatcaggtagcctttttgtcactacttggtactggtgtagcatgacccctttaagacgtgtaatttcagttcatttaaaacctgggacagatttttcctgtgcaaatcaaaggataatgggttggtgctttagtttgcttcctaaaatgtttaatggggttagtgttctggaagcatcctaatggctattttaaggtaggtaaaaacctaagctgttgcaacagaggcttattacaagtgatttagagaagaaagcattttattctcatagtattttctttacagtgtgaggaaatgttctttttggtatacaattctgagatttaactaatgcaatccctgtgactaccataatcaggattcataaatttactattattatatggtgtgcatgtacatgtcaagtgtttgagtgtgtgtttgcatgtcccatgtgcaaaggaatgcgggtggaggtcagaggacaacattagagttaagtttttctattgtgagctccagggattgtactggctagttttgtgtcaacttgacacagctggagttatcacagagaaaggagcttcaattgaggaaatgcctccacgagatccaactgtaaggcattttctcaattagtgatcaagggggaaaggccccttgtgggtgggaccatctctgggctggtagtcttggttctataagagagcaggctgagcaagccaggtgaggcaagccagtaaagaacatccctccatggcctctgcatcagctcctgcttcctgacctgcttgagttccagtcctgacttcctttggtgatgaacagcagtatggaagtgtaagccaaataaaccctttcctccccaacttgcttcttggtcgtgatgtttgtgcaggaatagaaaccctcactaagggatcacatgcagatcctcaggcttgtgtggcgagtcattttaccatctgagctgtcttgcttccataatcaggagttaggttggttctgtcgctacccgaagctccctatgctgctttgctgtcatctcctcaccctgacattactggtcatattttaattcttacagttttgatttgttctaaaaatagaatggccctgtgttggttgtcggagtcttactaagttcttcctcaagtgtagtgcattgtgatctgtccttgtttcctgttagtagttacttccttttcttagatacgtttccattgtttggctattgcttttgtttatctttcagcaggtggatgaggagcgcttgctagatttccattctagcattgctgcagtgagcttcttatgaggatgggaggtgtgggagcctgtgcttctgaagatgataaagggacccacgatgctgccgtgctgctctgcactcttcttattgtctttatttatataattgacactcgagtgttgggcatgtttgttctgattggaggaagatagcttggacattcagatacaataggaattctgtatatcacttgcattcccaatacatttatgggaggaagttatgtgcttgtgttaggcaaattttggtgggtgaccagcagtttacgtgaccggtcagaaaaagtctctttctgggaagacataagctacttttttttcacatgtctgacttttctgagtgtcgtgtgaggaagctcttagtagacctcatctgtcgtcatcccttcctcatgctgccctcttcccagcatggagtttatgattcactagtagtagccaaaacgtacttaggaatgaatgaaatatagaaacaaacgaagtagtcacctcagtggatgctcatttcttttcctcttgtttttttgtagaaagaaggaactctcagccaccaagaaagaccgtgtgaatcattgtctaacaatatgtgaaaacattgtggcacagtctctcaggtaattggctttttaaaaaaaagatttatatatttatgtatatgagtattctgcttgcatgcatgcctccatgacagaagagggcatcagatccctttatagatgggttgctgggtagccagtgctgagccatctccccagcctcttcttttctttttgtttttggttatttttgttgttgtttttctttttttgtttaaaagatctctctggtaattactgagttgggtggtggtggatatacctgtaacctggcattcaggaggcagaggcaggcagatcttggtgagttcagggatagcctggactacagagccagtaccaggacctacacaaagaaacctttaactcataaaaaacagaaaacaaagaagaagaagaagaagaagaagaagaagaagaagaagaagaagaagaagaagaaggaaggaagaaggaaggaagaaggaaggaagaaggaaggaagaaggaaggaagaaggaaggaagaaggaaggaagaagaaggaagaagaaggaagaaggaagaaggaagaaggaagaaggaagaagaagaagaagaagaacaacaacaacaaactggttgctgggctgtggtagtgcatttctttaatcccagcacaacaacaacaacaacaacaaactggttgctgggctgtggtagtgcatttctttaatcccagcacttgggaggcagaaacaggtgactctcaaggccaacctggtctacagagtgagttccaggatggctagagcttacacagagaaactctgtcttgaaactccaccccaccccaaactatatctaaatactctgtgttttcactattaatgcattaccatgttctttgtacccctagctatctcttaaaagttcatttaggctaagcgtattttggtacatgcttgcaatcccagtatttggcaggctgagacaggaggatcttgaatttggtattagcctgggcaacatagcaaaaccctgcatcaagaaaaatccatttaaaatcaggacgttttaccacatttgtagttgtgctataagggtatctgggttctcttataggaaatgttttcttcttgtcatcttatatatgagaattttagtcatatgataattgaatggcatgttagtaatttaatttgtattcttttaaggtttatttatttttaaataaatgaatgagtgttttgtccctattttatatttgttccctgtatgtgcctggcacccacagagaccataagaaggtactggagttcctggaactggaattaaaagatggtcataagttgctgtgtggatgctgggaaacaaacttaggtcctctctgcaagaatagcaagtgctcttatctactgagcctcctactttctgtttgtttgtctgagacaaggtctcatttagcccaggatggcttcaaactcactgtatagcaaaagatgactttgagttcctgctcctcttcttctgcctcctgaatgcttagactatagacctgatctcttagagtttctattgctgtgatgaaataccatgatcaaaagcatctttcacttatacatgtgtgtaacagtctatcactgtagaaatcagggcaggatctcatacagactgtggaggggtactgcttgctggcttattcttcatggcttgattggcctgctttatagaagccaggagcatgagcccaggggtgttcccatccacaatgagcctggcccttccccaccaatcattatttaagaaaatgcactatagactcttctgcctaaagtcccattttatggaggcattttctcaattgaagtttcttcaaagacgagtttagcttatgtcaccttggtcagaaaactagctaggacacttggctttagaatatagcttcaatgtcaaaattccccataatcaaaactgaaagtaaattcaacttggggattgtattggcaatttatataaattaaaggcttaatagtctgtagggtgaaccattacagagcagagtattatcctaataagaaaatacataacacacacacacacacaatacacatatttcaagaaagaaatttgacttggctactactcaggcagaggcaggaggttcatgacttagagactttttatagagccctctttcaggctttataaaagcatgacttcttctcaaacaaaaaggaaagaaggaaggaatcagggtgggctcaatgtttatttcgtgttttctatattagaagttcatctttattagttattatggactaaatgtgtatctccccaacccgtctgtatgttgaagatctaatcccccattctgaaactgaaaccaactatgcattttagtaggttaattcagtgttttcttgaagttaatctcacaacccacatagttatacagctttgtctcatgggctgttcttcatgtagtagtcacaggcttgtgggaggccactgagtgactaatctgagatttgaatgacctttctccttaggttgaggagtttgtggtgtgctagcgtggcttgcagaactcaagaaaatactaacattttctggcttgctacaaagctatagctcagtagcagccagattgtagagactcagagggtaaggtatgggagggaagcatggcccctctgtgctctcttcttccagtcttccatgtgtctcagcatggacttctgttaccagaaccaggagcttgatatgtgttgtactttaagcatcaccattcacattggcaacaaaaatcatcagaatttttttcagagggaagacacttggggccataatagagacagattaaagtggtgtcttaaaaataaaatctgaccacaataaaaatcaatcagaaatgcaacaaagtataggaagttacaatttgtaacaagaacagttagtcaatgttggcccagaaattaaactaggttagcatacacaagcactaaaacagtataagaaacatttaaacagtttaactttttttttttttaatgtctaagaagcaaaaggttgagggtatgggaagaagaaacaagacaggaaaaaggctgagcctgaactaaaataaggagacagcctacttcttataggaaatgcctgccaaaatccagggaagtgccatctgtaagtcattctatcctcagtaaaaatctcttgtaaaatgaaaaggtgaaataaagaggttctcagacatacctctgaggagtaccctctgtctgacaagcagtgagtttaagacattttaaaggaagtgtttcaagcagatagaaaattataccagatagaatctggatctgtccaaaggattgctagcagatggataaacataggagatgtctgtctgtctgtctctgtccctctcttgatccctctccccctcccctctctcagacaagattatgtactgatgtagaactagtgatcctcttgcctgtgctgcttgggtgctgggattacagaaatgtgtctcatgcatgcagcagcaacctgttgcatgacagacaacataggaacaaatgtttgctcaactcatagggaagcattaacaaactaaagtatagatgcctctaaaatccaatttggtgaaccagtggatgcataagggttacttacagtggtatgggtgagtggttccttataggatcatggatgactcaaaaggcatcaccaaaatcccaccctggcatgggacacagctcactaaagctagaaccctggaactctctgcgcaacttagacttcagcagttcaggaatccccctcccctcagcagtccttactacttatataacccaggagtcttagtcagggtttatattgttgtgataaaacactgactaaaagcaacttggggagggaagggtttatctcagcctatccgtctacatcacagtccactgagggaaaggaactgatacagagataatagaggagtgctggggggatggatggctcagcaggtaagagcactgactgctcttctgaaggtcctgagttcatagcaaccacatggtagctcacaaccatctgtaatgagatctgatgccctcttctgtggtgtctgaagacacctacagtgtacttaaataaataaattaaaaaaaaaaaaaaagagtagctctgcttactggcttcctctcatggtttgctctcctgcttcttttttatatgccaattgtgcagttccttttttttttatattggatattttctttatttacatttcaaatgttatcccctttcccggtccccccccccagaacccccctatcccatcctcccttctcctgcttctatgagggtgttcctccacccacccagccacccaccaactcccacttccctgcccttgattcccctatactggggcatctatcgagccttcataggaccaaggacctctcctcccattaatgcctgacaaggccatcctctgctacataagcagctgaagccatgtgtactcctttgttaatggcttagtccctgggagctctgggggtctggttggttgatattgttgttcttcccatggggttgcaaaccccttcaactccttcagtcctttctccaactcctctattggggaccccatgctcagtccaatggttggctgcgagtatctgcctctgtatttgtaatgctctggcagggcctctcaggagacagccatatcaggttcctttcaacatgcacttcttggcatctacaatagtctctgggtttgataactgtatatgggatgaatccccaagtgggacagtctctggatggcctttcattcagtctctgctctatactatctccatatttgttcctgtgagtattttgttctcctaaggaggactgaagtacccacacttaggtctttcttcttcttgagcttcatgtggtctgtgaattgtggtctgtatcttgggtatttggagcttttgggctaatatccacttataggtgagtgtataccatttgtgttcttttatgattgggttaccacactcaggatgatattttctagttccattcatttgcctaagaatttcataaattcatcatttttaatgactgatagtactccattgtgtaagtgtaccacattttctgtatccattcctctgttgaaggacatctagtttctttccagctcctggctattataaataaggctgctatgaacatagtggaacatatgtccttattatatgttggaatgtcttctgggtatatgcccaggagtggtatagctgggtcctcaggtagtactatgtccagttttctgaggaaccgccaaactgacttccagagtggttgtacaagtttgcaatcccaccagcaatggaggagtgtttccctttctccacatcctcaccagcatctgctgtcacctgagttttttatcttagccattctgactggtgtgaggtggagtctcagggttgttttgatttgcatttctctgatgactaagggtattgaacatttctttaggtgcttctcagccatttgatattcctcggttgtgaattctttgtttagctctgtaccccatttttaatagggttatttggttctcttgagttctttgtatatattggatactagccctctattggatgtagggttggtaaagatcttttcccaatctattggttgctgtttttgttgttgttgggttttttttgtttgtttttgtttttgtttaaggtcacatttttaaattcttgatcttagagcataagccattggtgttctgttcaggaaatttggggacagagagtcattgtgaatctgataaacttcagggacttcctaagatttctgggctgtttccttccttgagtctctttgtttctttgtttgttttttgaaatggagtttctttagtccagccagtccttaaatgtactatttagatcaggttggccttgaactcacagagatttcctacttctttctcctgagtactgggattaaaggcatgtgccaccttgctcagccactttctgagtcataacaagcattccttcagaagtccctgactctgaaaaagcttgctatacagcacaatcttttctttttctttttttctttattttatgttgattggttagttttgtgtgtgttatgtcaatgggtatgcattgacatagtgcttgtgtgtaagtcagaagccaactttcaggtgatggttctctttttatgatgtgtgttctgaatattgaaatcaggttatcaggcaggcctgctgttatttgctgactacatgtagaaagtatattttagatatgtctgttgagtaattagccttacttctttcttattatattgatgctactggaaggaatcctgagcccatgcttagagctgtcattaatttctgttttggcactgctaagactgatgtctgagggaaagcctctagtgtcagactttccgcctttcatcctagtttattactgtattcctttccagtaaggtctatggcattgctgagtgacatgtctttttgctctgtatgtgttgagaattattgatcccttttctttctcttaggtttatggatgtctttcaatgccttttgagccagagtctcattgtgtagatctagcttgcctagaactcataaagatccccctgcctctgcctccctggtgctgggattaaaatcacatgctagaattttttaattagaggtaaaagagaaggtgactgtatagatcatagtcctttagattaagatcctagtacaacagtctgcttttgatgttttagaaatggcatgccccattcttaagtcaccagaatcactttcaaatatgccttgtgttacaggtttgagatactttagagttttccactcaagtggcccaccagcctcctcttctaatgggcgggcttagcttgttggatcatgacataccaaacaggttttctcaactaaacttactaaaatactttacaaatagtacccagattgtgataccagtattcggtttcttgcaacagaaaagcctgtaagcctgtggaatctagggaaatgtagttggacctttatgcacattgaaagtaagattgaaaagaaataaaggagatgtattgacttgctgggttttcaaggcttcaaggatgctatctaaaagtaaatctacctttttacaaagcatatgattacctgagatttgagaatcctagacagtatcttctaaagatgtttcaatgaaatcttaaaaagaaaaggggatcagtaccaatatgctgctcaccacagtccacctttacgccgatattcttaatttttatgaaatgttctttcttgtcctaaaattccatttagattgctctttgcattttgtcatcagttctcctagatctgtcatgacgatgacaacctctctctctctctctctctctctctctctctctctctcttttttacttagaaattctccagaatttcagaaactcttgggcatcgctatggaactgtttctgctgtgcagtgacgatgcggagtcagatgtcagaatggtggctgatgagtgcctcaacaaagtcatcaaagtaagcgccccataatgatgataatggtgatgcgtgctcctgtaattgtcatgccttaagagacaaagctccagatacctacattttttccattttgggcatgtggcttggaggacctggggtattttcccataaacagctaaatgtgttcctgcggaacttttttttttttgcacccttatagttcataggtccattctgaagggcatctgtgtgaccactggctgcctatttcttaagaggaatgtctctatgggctgccacttttgtttgggcattgcttggagaacctcagagccctgggggcacaaaggtgggtgtggggggaatgaagtcttgcatgccttccttcatttcttttcctgcccctcttagtggaggtcagacaatactgcttgttggtgaagatgtagcttctcaggttaggttaattggaggtagcatgacctgaatggggagagaggagagtacagacaggagaatggagccaggaagcaatagccactcaggtgcagtgccagaagaggtgaaaaggctgggcacctgtctcactatgtcattgcttcctagtactgagtgcagaccactgcaactccagtctgtttctttgttcagttttctgctatgaaagaagattgaagtcctccttccccgccctcatcctaatgcaggtgggcattaggaagggcagagagaacaatgtgactctaaattgaccatatccttgttacttcaagtgcaagcagcttttcctctcaaacctctcttctgccgtggctgatgctggtcaggttggcttggtgcatgtttgaggccacagaccactgttgtagcttgcagctttatgttctggatctttggctgcctatctccactttcttcctgtttctttgtggtttctagtcaatgtcaggaattccagcttttacagcacagccctgagtcaggccaatcttcattctttcccttctgcttatagctgctttcatgtttctgccttttcaactgctgcaatgttcaggataagccagtaaggtggaccaggatccagctattcactatgatagaggaaaggcgaggcaagatgggagaatgggatggcttcaggccaagtgtagggaatggttcactttctagtctgggacttttcttttcttgaaagaattagtgtatgtactataaagaccaatttctagccccgaaaatgggcagatattacttgtcttttatgttcaaaatacattgagttctgatagccaggatgtgtattcctgctttcaagtcttgggtggtaaagtgaatgtgtccagaactcacccatggtataaaatgcagagcagaaagaaggtagtaatttttttttttcccaagaagatagaagtggtattctggagtcaggaaagaccctcccatttttacctactacctggaggtttgtctcagagaggagagcaggccctttttaggctgtgaaaaatggtgtgtcttgagggtcagtttaagtattttgtgtcttggtagaaaatgaaggcctcttgcagatcactggctttgtgtggaagccagttttgatagggaatgaaaagaaggaccccagctgaggggaaggcatgagctaggatggtgtcagagtgtgttttgtcagctatgtgtggaggcaggttgggagttgggggtaaaggaagctataatgagctctattatcaccccatgaaggactcatggaagagccatgctctacccttaacagagttgagcttttgttttctctactacaaaataaagtagattttggttcataaacatttatatagctcaaacagtatttgatgtactcttaaatttcatttgaaagtagtcttttaatgtttgtcagcatggtttgcttcttttgttcaaactacagcagcagaatcagggtctgaaatttcctggtggggccagagagattggttaagaagagaagttactgcttttgcagaagacctgacttcagttcccagtaccataagatgtcgtataaccacttgtaacccaaatttcagggggtcctgtgccttcttctgacctctgtatgttcctgtacatatacatacactcaggcacacataaaatgaatttttcaaaaaaagttggtagaatgttatacttcttctgaatcaattttccaaagtgtgcctctgttttacctttgaaactcatggcccagtgaatgatccctgtgtcctagtttcatctctttggctatgataaatatcctggcaaaaaactgaagggagaaagaacttgatttagaacttcaggtaacagtccatcattctagtgaactcaaagcaactagaacgcaaagcagttggtcacagtcgcagtcaagggcagaaaggaaaagaatgtgtgtgtgcttgttgctcagctgtcttcctctactttaatctgtcctaggtctaaaacttaggcagcggtgttactcattttcagcattggtcatctcacatcaattaaggcaatcaaaatagtccctcacaaatatggccacaggacaacctgatctagacaggatcttaatgagactattcccaggtaatctaggttatgtcaggttgacacagctaaccatctcatctctccttggtctctagatatcaggtttgcatgtgcctgaaaaggagagctgggtcacttcctcacatttttttgacatgccattttagaagagaaagttcttagggacaagaatagggtgattttctctaatgtggactttatgctattagccttgattgtggctcgaagtcagatacatgaaccttatgttttagttagagttttattgctgtgaataggcaccatgagtacagcaactcttgtaaggaaaacacttagttggggctgggtcacagttcacaggtttagttcatcatcatggtgggaagcatggcagcatgcaggcaggcatggtgctagagaggtagcatagaattctatatctgcactggcaataggaagaaaagactgccattggccctgtcttgagcatctgaaacctcaaagcccacccccagtgacacacttcctccaacaaggccccacctactaatagtgccattccctatgggcctgtggagccattttcagtcaaaccttcataccttatttctgagttagccccaaagtgatcaggaaaggtcaagaaatgagctctgaggactgtaagacttcctagctgacactgagacctgggtgggtcagggagttggggctgtgagcatcctcatcattttgcaagtttagaacttcaaaaaaagatgattctgttgttacatgttccctgtcagagagaagggctcagatcctacaagtacaatcctcatatcttgcttacttagagactttcacctgagctgtccaggtgagccagtgaagactgtgtgcttactctgaaagctttagggttaattttaatttgatattatatagtatttgattactataaatgttatcttctgtttttatcctggtaaagacctgtatttagaatattctgtaatttttatatgtgtttacttttttcttaatatatagcttcttatttagttgctgttaatgttacttttccttaaaatttgaacttttggttaccatttagctttatgggtagaatttagatctataggtagaatgtatcttctataacaagtctcttctatttctttgcaggctttgatggattctaatcttccaaggctacagttagaactctataaggaaattaaaaaggtgggtgtttgctctgcattattgagaagatgatactgttttactgttgagtaccctatgagatttctaacttgcaagttattaaataacactgttaggaagaagtgccatttggtgaagcagagtttagttttctttaaaaacgtactcctcattttcattaattgaaatagaaatttatagcaccaccttaaattttttaaagatttttttttgttttattatatgtgtatgagttgcctgtgtgtacatctctgcaccgtgtatgtgcagtgccttttgaggtcctctgcaagagcagcaagtgctcttaacccctgagctgtaactcctagcaaccaagcaaccaaccaacaacttacttctcttctctcttctcttctcttctctctctctctctctctctctctctctctctctctctctctctctctctctctctagcatgaccccagccagttctgaggttgaaggcaggtttcccccccatctacttttataatattttagttacatgcaagtaataaggttaagcagtacaatagacacaaacagtcaaggaacaagctaggcaataaagaaagtctcttgatcactcccgtgatgactgtttctaagggcttatctggatgaccaaaatatctgggcctacttccctgtcttagctcaaagtcatattcatgcctgaagcctgttctagcctaaaattacattcctgcctgagcttacttccttgtcatggcctagtgtcagatttctgctaagtggtcccaaaaagctctccacatctcccccttttttatttcataaacaagactgcacctgtcttaggtggttctaacaagaatgccttccttacatgtcgtggaatatctattatcaaagtcgtgcatttctgtcttaggttggtaaggctctgtgcagaacttacccgtcagcgtcaatggctgccggcctattaaattaataattctgtctgggggttcatttttagtttcaaaccatgtattttggccaccaacatgttgatgctattaaaggcaagttttattacagtgggcaggaataaaaatattcccaggacaaaaagggctatcatgatcaagctatatgtgccattcttgaagcttgaccaagatggaaatactgacatatattcatgaataattttatcgacaatacctgcagcgtcagagctcagcagagtaccattctttaaattcataatctcaatatgcaaaattaaaacatccagagaggtgttagaattatgccaaatactcttcaagtgtctttcaattttcccaattatattgactctcattgtaaattttagaagtaacacaaatcccttggtatttcgcataacacttgagatggcttcttactcttaaactctaaacctcctctcataatttgaatattatcaataaagagcataaaccattgtttcggacacctatctaaatcaatctttctttcgttcttccttttctttttttaaatctgtatttttataattgaagccctctggattttaaaaatctttgaagtaattaccatctatttcacactgttaattttgactttctctgattaaattaacagagaaagagaatgtttaactctccaagagaggatgcaagcagctccaatatcatagacctagctgtagaaagtgcatgtgactcttaaatgtaacacatcacttgttaactccacttagaatggtgctcctcgaagtttgcgtgctgccctgtggaggtttgctgagctggctcacctggttcgacctcagaagtgcaggtaagttgtacctctgtattatttttaagatttgtttggtaaatagctagtcctgcctgtcttttttgttccagtgcatatgtctacaccttgagacatcattcttgtccactctgtgttgcctagctatgtcctgtctggttgctgtcagcattttgttcttatatttctttccaaagacccatctctattaggaatactcttatgtcctctattaatgtgcttctttcttgtcccatcattccccaagagacttgtgggatgtatttccagagtaacatagtctcaccatcttattctgtgcttcatttccaacacgaatgtagtgagcactcaatgtgttggttaaggaatacttactggatgaatgacaactgtccctgatcccatcagcagcagagttagcaattattgaaaaataatcatttgtatagtacttgggttggagaagtagatgaactgtgcataaaatttgaacttgttgattgtctttgactcctatggtgttaggtattaaatccaggagctcaggcatgctaggcaattgctttactgctgagtctcattgtcagcccacacatctggctttgtggcttgagtaacaaaacaggattgtagttataccgttctttcctttttctcctcagttggtaaaatgtactgcgtatgtcccaaagactgtatccgtgagaaacatagtagagtgctctaaatcttcacactaacaaggaacaatgatgtgttcaatttaggttaagtttcagtaagaattttatgtggccagaaagatgtaaccacgaaggaagtttctttctatagaacttttacttttgctctgctgatatgtttatttttgtgttggctttggtgctaaggctaggcatgcctaagtgtgcgcttccacacttccacatttccagctcaagtgccttactttgaaaattgtcatattattgaggtaatacatcccaggtttacaacacagcagacaaaatagctgttcaaaagtatgactgtcctgtcacaggcccttccttaaactctcttaattattccctagtgttgtttagataaaatctagacttcccactcaaggcaagagataatttagcctttgctggccctttcctatctcatcactaaagaaatactatattgattcattgatccaatttagttcttcaaataggttttatttcctcaagatagcttgatgtctcagaaaataatcacctccttctgcaagcattctagcctccttatcttctaagttgtaactgatttctgcctaacaaagatggctgtagtatctgtaggcctaattgctatataagagggccttggccccactatagcagacaccctactccatcctcgtttttctgtctaaggtaaggaattgttgtttgaagtccccatttaatttgaccacttttttacccctagagattgtgcagctctcctggagagcataaaagaaacttgtgttgatttctaattaaaagaagctgggttaccaaacaaaagtcccataatgtctggcatgccaaattaatgggtttatttggcttatatacaaaagcacggacaacttataagtagctatgcctttgaagcttcacctccagttagtttgccttttacataactcagtccttctaaggttatgtatccctgtagtacaaaggaatgatgattggaatcttggggtcttatgacattttctttttctccccaaaagggagtattatcagactatcccatagacctaggcacctgctctgtagttctccttgctttgttgtctgcttgtggctccaaggtctccatataagtcaccacagctactctgcttcatggtagggatggtcatgtcaagtgtacaggaaacagctagcccacagtagcttttaacatgactttttcagtaaaatgatgtccacattttattttgtttttcaaaagttactgtataagggtacataccagtacctgtatatagaaaggtaagaggagtgtcattcctgggcatggttcctcaggagctgtccagcttgtttgataagataaagtcttcactgccctaggatctgctgatgcgacttggctggctgccccttaacctcagagaatcactggtttctgacttcctagtgcagggattacaaatgagcactactatgtctgggtttttatgtggatgatagggatcgaactcatatcctgtgcttggtgcataagctatctcctttgttccctccagtttgtgtttttaaagtagtagtttttaatctattgtttcctatttaaattatattttaataattgctataatttgtgacaaattttttaaatatttatctttaatatttttttacagtccagtctttatccctctcctgatctgccctcccaaagtttttcaaacccaaaaaaagaagaaaaagaaattggagagatcgtacattagtaacttaacagaatacctgaaagccctagaacagaaagaagcaaacgtgtccaaaaggagtagacaggaggaaatagtcaaactcagggccaaaatcaaccaaagagaaacaaagaaactgataaaagaatcaacaaaaccaaaagctggatctttgaaaatcaacaagatagataagcccctagccaaactaaggggcacagagacagtatccaaactaacaaaatcagaactgaaaagggagacataacaacagaacctgaggaaatcatcaggtcctactacaaaagcccaacaaaactcaacaaaactggaaaaatctagatgaaatggttgattttctagacatataccatgtcctaaagttaaatcaagatcatgtaaactatctaaacagtcctatatcccctaaagaaatagaagacgtcattaaaaaccttccaaccaaaaagaagcccagggccagatggctttagtgcagaattctaccagaccttcaaagaggagctaataccaacactcagcaaataataatttaaatccaactttttaaattacattttatttgtctgtgtgtctttatatgtgtaccatgcctttgggtgaggataacttatagttaattcttcctttcctctatgtgggtcccagagatcaaacttgggtcttcaggcttctccttctttacccacaaagccatcttgcttgtccctacacccagcttcttaatattctttgtaactcatgggagagatgacagacaattgaacttcatcagcatttatgcctcctgtacttgtagttgagcattgtggtctccattgaggactaattcacctataaaactaggttttttcctgacagggaaccatgagcttgttgtttcttaacagaggagacctgaagaatgatgagtattcctcttgcacatacaggccttacctggtgaatcttcttccatgcctgacccgaacaagcaaaagaccggaggaatcagttcaggagaccttggctgcagctgttcctaaaattatggcttcttttggcaatttcgcaaatgacaatgaaattaaggtatggctgttgcctcttggcatgagtcttgtgtggctttggggagaaagtcatttgagattgcttctggtgtccttttggcttcactgagagacatctcaagaacttctttttacttctgctttcctttcatggggtaagttgtcaagggaaatagcttatagatgcaaattcaaaggcatttccccagagtggatttaggtatactgggttggccacttgagccagctaaggaaaagagacttcataggaaagagtgaagaagagttaatgggccttgtgggtgtgggcgccctaaagccaccaggactcgagtttggttcatagtgcccagaaagcaacttattacataatttgtgggttgcaagattcttggctttgattttatctttttgaaaaagtattttttttttaatttatttatttattatatcgttacggatggttgtgagccaccatgtggttgctgggatttgaactccagaccttcggaagagcagtcgggtgctcttacccactgagccatctcaccagccccagtttttatttttaaagtatttattttatatgtttgggtgttttgtcaatgtactgtatacatgcctactgttctcagaagccagaaaagtgttggatatcctagaactaaagttatagatgattgtgcgccaccacatgggtgctgcaaactgaatctggatcctctgaaagagtaactagttctcttaagccctgagcccactctccagcttctaccttttctcattgtttatctgtgtaagtgcgtgtgcgtgtgtgtatgtctgtctgtctgtgtgtctgtctgtatgagcctgtgtgtgaatggaggctagaagaaggtgctaggtgtccgtctttatcactctctgcctgttctttttgaggttgagtttccctgaacctgaggcttactttttttttttttttaaattggacattttatttgtttacatttcaaatgttatcccctttcccagtttcccttctgcaaaccccctatcttatcaccaccctcaccctgcttctatgagggtgcttatccacccacccaccctcccactcactcctgcctcactgccctagcattcctctacactggggtatcaaacctttataggaccaaaggcctcccctcctattgatgtcagataaggcccctttagctccttcagtccttctcctatctgctccattggggtccctgtgctcagtctgatggttggctgtgagcctctgcatctgtattggtcaggatctggcgatacaggagatagctgtatcaggctccggtcagcaagcacttcttgacatcagcagtagtgtctctgggtttggtgtctgcatgtgggatggatccccaggtggggcagtctctagatggcctttccttcagtctctgttccactttttgtccctgtatttcctttagacaggagcaattcttggttaatattttggagatgggtgggtggctcaatccctcaaccagggggccatgcctaacctctgaatatggtctcaacaggttctctttctcctttgtggggtatttcagctaatgccatccctgtggggtcctgggaggctcttgctttcctggcatctgctgctgctgtcagtgttattcctccctccttggaggggtggaagctcctgatggtgcagaaatgagtactgcaatactgtcaagagtctctgtgataactgctgtcagagccaggggacaggtgtatacacacacacacacacacacacagtggttggttctggatctttccatgatatagatgccatttgagtaaggtaatactttcctttttttttttttttttttttttttttgtatgtatctgtagctgtacagatggttgtgagcttcatgtggttgttgggaattgaattttaggacttctgcttgctctggttggctgtacttgctccggtcaaccctgcttgctcaggcccaaagatgtatttattattattaaaaaagtacactgtagctgtcttcagatgcaccagaggcagacatcagatctcattatgggtggctgtgagccaccatgtggttgctgggatttgaactcaggacctttggaagagcagtcagtgctcttatccactgagctatctctccgccctcccccccatacttactaactacttccttcatgaacctgtgacatttaagagatctagtcattcttctgcccatgtatcattgctgtgctctagaaacaaatagtgccaccctgtcctacttatcttggttctgtgtcagaggcaaacaataatgcttgcttccctgggtttagatttttaaattttacatttgttttttaactgtagaagaggtgaatttggctctaacacttgtttctttttacaatagtcctgtatatattgaatatgtactttattatgcccttatcaatagtgatggctaatcgtatatgattttgaacacctttttgttttctaaacctaataattattggttgtttctgaagtctcaaacagaagtgccatttcttactcgttagcttgctcaatagatggcctatctcctttggcagttatcgtcccacatcctgcttaatatggccagtgattcttgagtttgtaaattctgtcatcctggagactcctttactgctctcctctttctggctgctgtcttctgtctaggtttgcttcccaaagggttgtgcaggaagcagttgggatttgacatccctaaaaattcctttggtatgcagatcactttttcctcaggagaattcaatctttgttttgtagtacagaactggaagatcctgtccacaccaagaggcaggatccccaaggagttaggtgtgtggtgtaaagagggacgcctgtaaggaggctgcagcggacagagtgtctggagagatggggttctaggtcttatgtagtagtggagtctccacagaatggacccacagtaagaggacacttgcacacaggctgccatagtactgggggtgatatcctgagagatggaactaggatgaaaattgccagagtctcaccctggtatggactggggggggggggggtgtcgtcctcacataaagtgtttctcggtaaacaggctgacatgaaggaatggggaagggctagaaggtagggctgagagggtccacaggaaagagtaactctgagtttccctttttaccattcttacgtgtgtgtttatttctattagcacttttattggtctgaatatcatttgtggggtgtgtgggatgtgtgtgtgtgcacgtgcgcacgcgctatatcatcatcagctagccatacaagatatacagagacatacttacaatcagttgcagccaccaatgaatgtatcaccagtggccctgaaactgacaatggcagttctactatggaatgtgctatgaagtcaacagttagttaggctaagtgtggaaatagtgagtgaatgagataaaggagggacataggcaaatgaaacaaagacaagagagacaaggttaaataaatgaaaggagaaggtggaggggtcaggaagaacattatgggcttattctggagattactaggaatatcttctctgtgatttcttagaaagtggtatgtggtatgctgtcatgcctataaagttgcaggcttccactcacagaggcaccagtctagggaggatgttttagtacagcagcacttctgcagaaaagtcttaggccagattatcactgtatttgtctagtgctttttccttattattgtcaagttttttaaaaaatttatatagtgttcttactacctctgttctggtataccacgagtagcctatagacactgagactgacacagtgaacaagttcctgatgaatgtgtgtgtgtgtatttcttattcatgtgggttctgaggatggaacttaggccatcaaccttggctacaaattcctttatcatttgacctagcacacagccttcctaatgcgattaataaggaagtaaatatactgctaataaatacttggtgactattgaaaatttggtattttttgctccatctatgaaaaatgtgtcatcttgtcacagtttttgtcctataagttttagaattctgtgaaatgtgtaataagctccatgggagcttcagttttcatcatcttggttttgtttgttctcaggttctgttgaaagctttcatagcaaatctgaagtcaagctctcccaccgtgcggcggacagcagccggctcagccgtgagcatctgccaacattctaggaggacacagtacttctacaactggctccttaatgtcctcctaggtaagagagaaagggcctgctggcccagtcttagcatctgctcaatcttctaaactacactgacccttgccatcatgattagaccatttgcagctgctgactgctaaatgtgaagtgtgtaggggatgttgcaagcccataaatggtctcggagacttttcagctgcggctgtgtctctaggacacccagctggtacacaacctcatccaccttcctgtccttctgtatcagaggcctgaggctatgcttcagcacgctgtgggtactctagggaaactgacattcccctaccccctctctcctgtcaaaatcaacatgaacaagtcttgctggaatgagcatatggacatttgatacaactctctgaattccacatggacatttgatacaactctctgaattccacatacagttccactccctataaggtcctgccaagctaaggatatattttatgctgcaaggctgcttttgatctgagtgtgcacagcctgtgtttctcagtctcgcttatgtcacctttcccttttactgctaggtttacaacagggcactcctgtaggtctccctttttcaccagcatgtactgtgggtctctgagcagtggactggctgttgagcccctttggttgtctttgcaggtctgctggttcccatggaagaagagcactccactctcctgatcctcggtgtgttgctcacattgaggtgtctagtgcccttgctccagcagcaggtcaaggacacaagtctaaaaggcagctttggggtgacacggaaagaaatggaagtctctccttctacagagcagcttgtccaggtaagggtgaatagtgataagttcatgtgggacatgaaagaagtagcatctttccgcaagtgctgggacagaggaagtagctgggagatggtgtgttccttttgctgctgaggagtcaggagatgtgtgtccacagatcaggtatgagttgtttgcttaaaacagggagcacacatgttttccacaaagggccagagtgtatgtgtgttaagctttgcattccaactatcttcactgaactcccccagtgatgtagtttgagccacaaatagcccataaatgtggccatattccagtgagacttcatccacagaagcaggcacacaatgaaggtacagttttgtatgcctgtgaccccagtacttggggtgtcaagagaaaagtacaagttctgcaaatgcctggcctatgtaggaaccccaagctctctgtagctgtacgatgagactagatctcaaaaaagccaaaatggggagtagaaagccagatgtggctgtggctagcagtttgccagtcaggatttaggggcatgcatatgcatacaggttgcgtgagaagagctaaagctaagccttaaggcagcttcctgggaggctttcgctcttccttttttattctacaccaacctttaaaaaataaaatgcatggttttggttttttttattgtacattggtgtttggcctgcacatatatctttttgagggagttggatctactggaagttgatttacagactgttgtaaactgccatgtgggtgctgggttcctttgcaaaagcagctcttaactgctgagccatctctctagcctgcatttgtttattttttgcttttatcttaccaactaatgctagggttggcaaactttgcaaagtaaaaatatagagtgcctgtgaagcattgattttatatagtgattgtataagaatggttaaaattgtccaggatataattatttatattgcaaaattatgtgttatctgaaatcaaggtttaaacttgtgggcttttttcccctggtaaatttaaagaaaaaactaacaaactcattctttctatagtatggtatagtattaaaaacaccaaaaaattttgactgccatccttaacatgtgtggctattttccccctggcattcagagctgtgtttctgatgatcggatgtccccacttgcttccatagcagtgtccattgggattattgtcttttctgttcatcagttttgggaaatgaagatcctgagtttgcttactggtgttctagaggaagtgctctatgtatttccaaggagttactataaatgaaaattaaaaaccataggaattcagaaaatagcacagacaataataaccctacctatggaagtaataggtctttacagggaaaaactaaggcacaattttgttgacaaagaccagtgaaaacaaaagtgaaatctgggatgcttatgtatttattaattttgtttttgtttttaagcattttaagatttatttattttctgtgtgtgctctgtctgcatgtacacctctgtgccagaagagggcatcagatcccattgtagatggttgtgagccaccatgtggttgctggaaattgaactcagaacctctggaagcaccagggcagcctggattgcagaatgagaccttgtctcaacaaaagaactaaaaacttccaattcactaaaccagcaaatgcattcttttctatgacctgattagcgcttagctgatgatggatgttgtctttgttggcagctggggctgagtgacccatctccttcacccccctgtcattccagcacctgctttctcttaaccgctgagccatctctcccgccctgggatgcattttaaacatgatgtaagacctgtgtttctgctcctaggtttatgaactgactttgcatcatactcagcaccaagaccacaatgtggtgacaggggcactggagctcctgcagcagctcttccgtacccctccacctgaactcctgcaagcactgaccacaccaggagggcttgggcagctcactctggttcaagaagaggcccggggccgaggccgcagcgggagcatcgtggagcttttaggtgtgttctcagcaaggtcttctaaccattgtgcatggaggcatgtttccttctgttgctttatggggctgtactgcgctgagctacccatgccgaaattccttgcccaagcttacaatgtaggcgtcttgctgcttttgcaaataaatctacagtttagaaagctagatgacacaatgaggccacacctttaaagcttggtctcctgcctttctggcttgtcacctccattttggatgcagtgaaatagaaatattaggcagtttccaggactctcatgtttgattgtcagggatgaatagatttttatgtctttttttgggaatttagtgttctttttctacttggatcctgactttagagaaccctttctattcctcatccttgaagatacctctttaacctggtctcgtctttttgatgctcaaagagtttgatccatagactaggcattggcagcctgacctgtctgacatgagctagtcttagatggtgggacagataggaatctgggcttgccagcctttagaagtgacctggcatttagcaggctgtgacaaattctgctgaccctgacttatcatggcttgccacagtatatacattgaggagccatatttattatagctacacattagagacagtctgcctgggaaatactattgtgaccttgtgcgcttaaaaatttgcctggactatgagcagaaactgttttactgctgtccttgttaaagaatttttatttttgtggaaagtatgtcatacaccctggtaactgtttccaatgaaagcttatgtctggcctatgcttgtccaataatgtgagatcttacagttttaatttggcttttaaagagcagtttatatgagcttttttgacattctagtcatatctttaaaactgtgtatttgaacatgagtgtaattttcacctttaaagtgtgacactgtggtgtttaaacatgtcctatggaaatatgtccacattgtctgttttaggatttgagttaagctttttgaggatttttgaatttcttgcagattttagcagcttgtaatcttactttcttgttactttctatgatttacagctggagggggttcctcgtgcagccctgtcctctcaagaaagcagaaaggtgattatctcaaaatctgagtcttgtgttgagttgaactgctgtttctgtgtttgcataatgcactagattctgcttatatttcctctcaggagatgaagtgtatggatattgctggaatctgacattttctgctgtttaaaaattgtttatatcacattatgtctaatgttcgaggtcaaaggtcagcaaactctataagggaccagagaacaaatattttaaacatgcaggctatagactctttttttgttttgttttttgtttttttggatttttgagacagggtttctctgtgtagccctggccgtcctggaactcactctgtagaccaggctggcatcgaactcagaaatccacctgcctctgcctcccaagtgctgggattaaaggcgtgctccaccaccacccagccatgctatagactcttgcagctgtttccctggcttgtgactgctgaagaacaatggtatagaaactgctgtgtctagctgttttccactaaaatcttaaagatgcagctgggctcagcatcactttagagagtgcaccactatactttagaaaagtaacttctgttttttgcttgtttctttttaaacatttatttatttgttttatttatgtgagtacactgtcgctgtcttcggacaccagaagagggcatgcgattcccattacagatggttgtgattcccatgtggttgctgggaattgaactcaggacctctggaagagcagccagtgctctctccaacctaacttctcttcttgatgaattttattattaggcatattaaatagtttattttgtttggttcttcattttgttcatgcctagttatcagttttcagacatatttaacttcttgcatatgtgttttctgacctatttttattccagagtttctgatatgacctgatagttttatatacttggtcactttgcagcagctgaaatttcattttatattatgaatttctgtggaaaagaattgctgtcatctttatttttaaaatcttaaaagatgagtttgttttctttgtcataatttgagcatttaaaacttaaagctcagtattatttgctatgttaagtgagggtttgtgtgtttttcctttttttaagttttgagacggggccttactgtgtagtgtgagctggccttgaactcagtatctcttcctgtacttcccacttgctaggatgacagtacacctcacttttgagtaagttcttcccaggaaaaacattgtagttgccattgaattaagagaacatttacttgaagaatttgggagctagatgttacccggaggctgagacagaagtcttttgggcaactgggaagaccttgcctcttaaagagaaagccgaatgtttgatccattgctgtaagaaatactgattttagaaagcattgccaatgtttaaaggagagtagaattctaagaaatattactctctattcttgatctaggagagatcactgggcacttggtaaaatcactttgataatttactccacagtcactttgtccagagatggggacaaaggtgatgttattgagataagttctcatctttactatttcctgaatctcctgatgattttttatttagactggtgattttaaaactttttttgttataatgaagattctgtttttttcaagtgttgtgttggctagtttttgtcaacttgatacaaggtagagtcattttggaagtaggaaccttagttgaaaaaaatgtcctcattagaaaggtctgtggacaaacctgttatgcattttcttgattgatgatatagaaaggcccggcttaaactctgggcactgccacccttgggctgttggttctgggttctataagaaagccaactgagcaagccagtaagcagcattctccaaggtctctgcttcagttcctgcctccaggtcccttccccaattcccctcagttttttcccaagttacttttggtcttggagttttatcacagctatagaagccctaactaagacaagtgtaatctgccagatataagatagataaaaacagagttgtggagcacatagacctcagcaaaggtcaaagggggccaggagtctcttctctgttggcagcccctctcctttttccatcttcatgggatctgccctgggggaacttttcccagatcataatcagccactgacttggagagtagaaactgcttcattaaaattcaaattcactgttcttgagttttatttgattattttaaaccacatgttttgttaataaaaggttctgtttgtatttatgtctagttgctgtgttgatttttgcatagatttgtgttctctttgctaattagcttgtgcctttaatgttatatcatgtaatttcatggaaagtatcacagctcttattacttgaagaacagtaacatgagaagctaacagctagatagtatctggtttagttttcccgtgtatgagaatatacctgaagtgaataacttcaagggaaagatttactttggccactgtttcagaggtcttggtctgtcacagcagggcagatttgttcgagcagcaaccagaaggcaggttgttatacctgtgttggtgtgcttcctctaagttttttatttcaacatgagaacaatgctacccacaccaagcaccagtcttcccttttagttaaccctctctgaaaattccctaagtatatcttctttcaatcaagctgacaagttcaaagtgtaacttgatgtcaattaatgtttatatataatgtaactgtaaagatattaaatctgatttttcttcctaatataactatataagctataaggtatatttctaaaattctactaggaaatattttgtcttttcagatttttagctactgtgtagactaaaaagataataaaatgaaagtgacttatttatatgttggagtttgacatacaacttcgtatttgccatggatattccattagaacatggatatcccaaggcctgactgatagaattggaccttttcagtcataagctactcattcatttattaactggtagtaaattatttaactacaacagtaatctaaatcaataaaaagttattatgtggtatagttcaatagtaattacttctgcctcttaattggttttacagtattctaaaagttactcttttatccatcctttaacattgtagtaatatttaatttatgatggataaattgtactatggtaaattaaatatgcctgtgattttcaattcagaatatatgcttatttgatttttgtcttttgagatagagccattatatagctttggtttggactaaaactcactgtgtagatggggctgacctcacgctcatagaaactggcatgctttctatctcctgagtgttgggagtaaaagtgtgcaccatcatgcctgactatttattcaagctaaaaaaacccaacattatttttagcaaaactaaaaaggaatattgctgtattatttactaggcaaagtgctcttaggagaggaagaagccttggaagatgactcggagtccaggtcagatgtcagcagctcagcctttgcaggtactcggtggcagccatgagctgccagtgtcagcctctagttattatccgccatctcgtgctcctttcagcacctcagcctgcacacagcattgcgagcagcttttataattcagctgcttttataatgttcactctaaatgtgtttggctatgtgcttttcttgttttaggctattcaaatattgatttattatccttgagcatatccttttggagtggatgatagatggagttgtctcctgaattaaatggtctatgatcaggacagtgggttgaagaactgtctgggtaatttaacttgaaaggatatatttttgctcacaagtggttacataagattctttgtgttttctataaaacacaggtattattttaagacactaataaatagataaaatgcaaacagctttagttatgtttgctgttaggtaaataaagataagacaaagatccttggggaggaaacctgaataatgtcaatggattttccctgcttacaagataaacaagtcacaggacagaaattttgggctgcctagactagtgtaaaactcaagtgcctctgacccagtttccttcatcacaagccactgctcataccttgttcatggttttgaagtgattttgtttttatatttaatgttttgttttataagacaaaccatcctgtcagcattctgaaagctcgcttttattggtataatctcagtgttcccaaccatcagaacctttcattccctgcaatgtaaatcaaccccccccttttttttgcaagttcttccaaacgtctaaggatgaataaatgttacatactggattttactattatagaatggcactgaagtgactttgatctcacatagtgtttgtaagagggaatttcaaaattaaactaggaaaagatggagtgtgtttatcctagaggaggttaggattggagtggagatgaacaacacgacttggaagaaagcaagctgatcctaaagggtactgcgctcactagtgttctgttgttgcctatgtagagtttctggaagtctgcttgtccctgccccagctgcttgtccctgccccagctgcttctcagcaacacacattctatgtgtggctttagagatgcagtaagagcttcagcttgaaaatattcacagccatgaagaattcacttgttcacccagctgaactgtgctccttgactttttcttcactatgctccaagctgtttaatagttagaacattcaatacagtgaactttttgtcattttgcacagttggattccttagctacagtttcctctggccatttgacaactgagtttctctgtgtctctagcctctgtgaagagtgagattggtggagagctcgctgcttcttcaggtgtttccactcctggttctgttggtcacgacatcatcactgagcagcctagatcccagcacacacttcaagcagactctgtggatttgtccggctgtgacctgaccagtgctgctactgatggggatgaggaggacatcttgagccacagctccagccagttcagtgctgtcccatccgaccctgccatggacctgaatgatgggacccaggcctcctcacccatcagtgacagttctcagaccaccactgaaggacctgattcagctgtgactccttcggacagttctgaaattgtgagtgggcagagggtgccctggttcttttgtcttctgagcttattcttggatgcccacacttggaccctcctgctcattttttctgtgttactacacataatagtaagaggcccccagctcagatggttaacagagagccttgttggatgtcttcactgtagaaattgcctagtatcatttgtattgagccatggagattaaagtgaggttacttatatgcaccttgtacacatgatatatttttaatacctgattaggcctgtttaaataactactttcaatttttcaaggagcttgttattgaaagtatctgtggtcttaatgtgggtggtgatattagtactctgtattatttttagcactttttgacctctcaatgtacttataccacattccattttaaagtaggatgtgcatatttctatccctgtgatgtctgagttcatagacaggaatcaccttaaagattatataatcagaaagtttggtgcaagtgtgtgctgaattgtggggtattttttgtttgtttgtttgtgtgttttgtttttttaaacttgcttgtcactttgtttttttgttttatatttctgaaacagggtcctagcccaggctgaccttaaatttgagatctgcctgcttaagctttggactcttgtgaatgtgggcatgaaccacacttggcctgcattctaaatagtcattttcttctcctcttcctctttctcttcttagtgtagtaaaatagcaaaattatctcatagatcattcctacagttaagtggtatattaatcaccaccatacacctccattaagtcttcatcttctgaaacctgaccttctgtaaaggctgtgccctcctggaagccagtggtctgttttttatagtacaagtttaaggactgtaggtccttcatgcagtatgtttatcatgaagtattatccttctatggctgacttacttaacataatgcctccatgtagcatgtgtgagaattttcattttttaagggatgattaatattccattgcatggatagaactacattttgattattgtctcatctgttagaaaacatgtgggttactctcacatcttgacaattatggataatgtcacaattatgaataataggtctactaagtatttcaaagactctgttttcaattcttttggctatacacctaaaagtagaatagtttctacatccagctttaagtaatgtaattaaatgcttagctactatagaatatgcatatatcttgatatatatgtactatagaatataatagtctatatagaatatacatatattacataatatataacctatatatattctatatagagcctatacataggtctttttgagacagggtttctttgtataatagccctgagtgtcctctacctactttgtagaccaggctggttgaactcaaagagatccacctgcatctccctcccaaatactgggattaaaggggtgagctatcacacccagcctagaatattaaaaaaaaaaaaaaaaaaaaaaaaagctggtctttgtgaccacacacttttgtaatcccagctctgggaaggtagaaacacccaaatgggtgagctccaggttcactgagagaccttgactcaaaaataccataaagaacaactgaggaaaacacctgacattgacctctcacctccacacccatgcttacaaatatgcatatacccactgtttgcttgtgttaccactccacctcaaacctcctccctccaccccccatacacattccacatacacagtcttagttcggattttattgttgtgaagagacaccatgacaaagccaactctttttgtttgtttgtttgtttgtttgttgttgttttgttttgtttttgtttttcgaggcaaggtttctctgtatagccctggctgtcctggaactcactttgtagaccaggctggcctcgaactcagaaatccgcctgcctctgcctcccaagtgctgggattaaaggcgtgcctggctacaacaaaggcaactcttaagaaggaaacatagggctggagagatggctcagcagttaagagcactgactgctcttccagagatcctgagttcaaatcccagcaaccacatggttgctcacaaccatctgtaatgagatctgacaccctcttcttgggtgtctgaagacagctacagtgttctttaaaaaaaaaaaaaaaaaaaaaaaaaaaaaggaaacataattggggctggcttacagtttcagaggttcagtctattatcatcatggcaggaagcaaggcaccatgcagagcaagtggtgtctcttaagttctgggctaccttgatctacaattgagttccaggacacccattggtacacagataaaccctgtgcctgtgtcaaaccaaaccaaaccaaaccaaccaaacaaaagaggttgttaggtcacatacacgttaaagatgtcctaagaggttttaactataggctgcagttctatctttgagttctcactgggtttactttgctgttctttccagcaacttttttaccacagaatctgtctgggcatgggaagtatatataaatttaatgcagataacctattgttagacttatctggaagccttgtctttttttctaacttattgtacagtttgttcaggaagacaaggttttaaaaatattaactcattgagaattgcatgcttgtattttgaggtttacccctcatctttctgactaactactcccagatctactttccacttctctttccaaccttatgtctttttttttcaatttttttattagctattttcttcatttacatttcaaatactatcccgaaagtcccctataccctccccccacccagctcccctacccacccactcccacttcttgaccctggcgttcccctgtactggggcatataacgtttgtaagaccaagtggcctctcttcccaatgatggccgactaggccatcttctgctacatatgcagctagagacacgagctctggggtactgactagttcatattgttgttccacctatagggttgcagaccctttcagcttcttgggtactttctctaactcctccattgggagccttgtgttccatcttatagctgactgtgagcatccacttctgtatttgccaggtactggcatagcctcacaagagacagccatatctgggtcctttcagcaaaatcttgctggcgtatgcaatagtatctgagtttggtggctgattatggaatggatccctgggtggggtagtctctggatggtccattcttttgtcttagcttcaaactttgtctctgtacttttgtaatatcaaaaatgtttacaaacagaaatttctttacgttttctagagctataaaaggttggtatgaccttctcctgggggagacaaacaaatatctgattaccacagataggataccagtgacagaccaaagtaatgattccacctaagtctagtttgacaagccagttagtttatttaacactacttcaaaggaacacaagccacggctacccaccagggcatgcgcaacttataaacatctataccattgaagagtatgtttatcccagcgatcattaaccacttatatatccttaggaaggagcagggttccacaagcctatccccagaatgttacttcctatctagtgcaggccttgtccaggtggcatcccacagcaaagcttttcttgccatagtagtgaagagctcttgcttgttgcttttaacacatgcatttacctgtggccactgactaggtaattgccctttgcattctgtatgtgttactgatgcaacatggtctttgcattctgcgtgctcagctctgttggtggcttttccttcatgttgaagggctttcccctgacagtccccctttatctgtacaggtgttagatggtgccgatagccagtatttaggcatgcagataggacagccacaggaggacgatgaggagggagctgcaggtgttctttctggtgaagtctcagatgttttcagaaactcttctctgggtaagctcttatatgatggaaatgtttttagccttagacatctttatcttttcttgtttgtttgtttgtttttgtttgtccagacggagtttctctttgcagcattagctgtcctggaacttactctatagaccaagctggtctcaaacttggaagatctttatgcctctgtcatccaaatgctgggattaaaggcatgaaccaccactagccagcgagacttttttatctttatttcaaaaagaaaccttttggtatcattattttttaaattgaaaatggcattaattttcatttcaattcaaaatgaaaatggcaatttaggtataatcagactgatttaaattggtacttgtatattatctctatataaatatatacatattttgattggacttgtcacttatttatgatttctatttttaaagcccttcaacaggcacacttgttggaaagaatgggccatagcaggcagccttccgacagcagtatagataagtatgtaacaagagatgaggttgctgaagccagtgatccagaaagcaaggtgagcttcataggaaggaacagcttgtgtgtgaggggttggaattgttctggcttttgccaattccatttgttcctagcccatctctggcttatttctttcccctagaaacactggacactcccaggccttgtctgtttatgcctcaccagggatacccaaactcttaacagttgcattagttctgcctccagagactcctccctacacagatgcaccctgtgctgagctccaccctgcctcatttgaggcttgtgcagagctttgcagcagttcttgtttttgctcactcaactgattaaaacacctctctctttctctgtttgctttacaagcatattacatataaatttacagttaacttaaattccttaaggtcaggaatatgttttgtcatttaattgtatcatcaaaattacttcctttgagagtgctctaggttcttttatatcctttcgacctttttttttttcagacagggtctcactatatagacctggctggactagaactcatagttttcagtagacaattgtgccttgccaatgtgaacagcctttcctgaatgctatgttttagcaccttcctgtctagtgaaccttctccatactaagcttgtctcttgctgcatcctacggccctgtgttttagggttccagttacgttctgtttgagatcagctatgggggtggccaagcataggcatctctgtgtctagcaccctgatgtggattactttcgtgactgaactagtgaatcaaatgtttacttctctgttctagccttgccgaatcaaaggtgacataggacagcctaatgatgatgattctgctcctctggtacattgtgtccgtcttttatctgcttcctttttgttaactggtgaaaagaaaggtaagcatagcagagtaggtacagagttgaggggacacttacaggttcaggagtcagtttgttggtctgttggtgtctggttattggggtcgtttactttccatttctgctgtcagagggagggaatgagagggtgagttttgttccttggaaaaggctaaaggggcctgggtggttcctttgcagcactggttccagacagagacgtgagagtcagtgtgaaggccctggccctcagctgcattggtgcggctgtggcccttcatccagagtcgttcttcagcagactgtacaaagtacctcttaataccacggaaagtactggtatgttacaattcactttttttcaccagctaatttgtacttaagctatctcacagtcttgccttcttttgtcttagagtagtgtttctaggtagcttatatgtttcagctgtgttagaactctccaggtgtgcatatggtcatgttcttagtcccatgactcccctatgtgtagttacatacaaatgactacataagtcataaagtagaaatctggaaatgtgaaagttatttatacacatacttatttcttcttaaatcataagctgcattgttaaattgctctgggccacatccatattaaattgctctgggccacatccatgttcaggctaagcctggtcaggacagcaccgtgacactgggtctgcttttggacatagttgttctggagtagaaagtatctgccaccttctttctttctttgagtgataaggcaaatctgtgttattgagtttaaagataacaaatatataatagattgattgtttctgatctttattttcaaaagaaatgtcagaagcttgattttattttttaatttttttttttttatttttggcttttcgagacagggtttctctgtgtagccctggctgtcctggaactcactttgtagaccaggctggccttgaactcagaaatccacctgcctctgcctcccgagtgctgggattaaaggcgtgcgccaccacgcctggctttttttttaatctgacaacctggaatcacaatttagaaatcctgacgtattgagataatttcaacgtgagaactctagaaactaaatcccaaacatcttttactacttaggaaattatagtcaggtcctttgcaaatgttcccttaagcttgcttcatttgtatataaatttgatgatggaagaaggtacagctgggccatttatgtccgcagaggaacagtatgtttctgacatcttgaactacatcgatcatggagacccacaggtccgaggagctactgccattctctgtgggacccttgtctactccatcctcagtaggtcccgtctccgtgttggtgactggctgggcaacatcagaaccctgacaggtaacgggacagtttgctctggtgtcttttctggatactctgcccatgttcatgtttctatagagatatttcttgctcatttttctggttaggaaatacattttctctggtggactgcattcctttactgcagaaaacgttgaaggatgaatcttctgttacttgcaagttggcttgtacagctgtgagggtgagtacaatgctttacataaactgttccttgccttagtgagcttaccattgatacagttaaatttggagcttaataggtcacatttccgtaagttgtaaacagttcttttccgaaatttaccactcagcctttgaaaaaacgttgccatcatattaaaattcattaaaacttttaattcttggactccttatttgaaacgttcttttctctaaagatagtgtttagaaatatacctttgctattttgaaatataaagtttgttgaataattacaattactgttttaagatactagaatgttgagctgcaatgaaattatgggtgttatttaactgggcctttactaaaagagccttgattcctcaagtgacagtaaggtgaaacatttcctattagctgcatcataagtcacaattgggcattcagtagcagaaaatttaactagagaaaatcaaaacaaaaacagtgattaagtctcaggaagggactatcattctttttagaaatgtaatggcctcaaagtagtgtttttctagatctaattttttaaaaagattttatttttttaatggtgtatatgtgtgtgtgtgtgtgtgtgtgtgtcagagtatgtcagagtgtgagtttctatctgtgagggtaatagcaacagatgccagaagagggcactggatcccctaaaactggaattctaggtgactatgagccacctgatgtggatgctgggaaccaaactcgggtccttcagaagagcagtaagtaggcacttttgaccagtgagccatctttccagcccccagcaccattgggtttttttgctttttttttttttttttttttttaagttaagttttagttagttgtgtcttttgagcaatgaaggcatgctgatagcacaggtgctatgctgatagatataagtgtgttatccttgtataggataactacaggataattaatgcctttaagctctgaggctgaaggtcctatagcaatataagatccaccttgattccttccttgtccatcaagaaagttgagtcacatctaagatactctttgatatgggtctcttctccttatgctggacctgagacttcttttcacatgtggcaggactatgttgtgtcatcttcctctaaaccagtggttagtgttcctgagattgaggctcaagagtcaaggcaagtaatcagaggcagaaagaaacaaaatataatgggcacatttacttttaaactcaagcataataagataaagatgtatcttgagtacttctgggaacctgtattgcttcttgttgctgcttaaagatagactagaacaaacaggtgcatgcataagagtgctgttcaaagacgcggtgcggtgtctgacctgatgccttctgtggtgggatgggctttcagcactgtgtcctgagtctttgcagcagcagctacagtgacttgggattacaactgcttattgatatgctgcctctgaagaacagctcctactggctggtgaggaccgaactgctggacactctggcagagattgacttcaggtaagggagccaagttacaattcagaagttcaaattaaaaattgaaagtcctgaggtctctgcagttggcatggctgtcatgtgtactgtctgttcagctcatctccagtttagttagagaacatgtgatagtcacagtactttttattgaactctgaacttggagattttgctattttaaatgagataagtttttctggttgtcctgtttttctagatggtaggagtaaaaaaaaaaatcagttatattatttttaattttgtccaaacctgtctgtctgtattaggcatatgggtttgtgcacatgagtgcaagtgcctgagaagaccagaggcgtcatagcccctggggcaaagtaagatggtttaagcctcttaacatgtctgccgagactacactccaggtccctggaagacctgaacgcatttttaaatgctgagctagctttctagccccactgagttgtttgttttgagaaaccttgtttcagacttttaaaataggctatcaactctgcttggtttttttttgttgttgttgtttttttttttaatgtacctttattctgatttaagggagatagccgaatagtattttgttgcagtttaaaaaaataacttgaggactggggagatgggtggtggccacacaagcagagcttgagtttgatagcagcacctacgtgaaagcaggtgtggtggtaaccatagtgctggagaagtggaggcagctggctccatgggccttgctggtcagccactttgcctagcatagtagggagagtccctgtctcaaagaaaaaggtggcttttcgccagcatggtgctgaaagtgaagtagagaactcttgcccctcccaaaactgaagtcaaagtgaagacagggaaagtttaaaaggcagtgtggaaggtgccctaacatcagccaccttccccttgggcagtccacataccctcatcagaacactcctaggagaaatgaagcttgacagtgccaccataatctagtctgtcccctaaccagtcagtcatgaagaagctagaagacaagtatgttgattgtggttgccaagaccaacaagcacaggatcaaacaggctataaacagctctgggacactgatgtggtctgatggagagaagacagcatggttgactacttcctgattatgatgctttgggtgctgcaagtaaaattgagattatctaaactgagtccagctggaaaattctaaatacacatttttttaaccattaaatgcccccactccaaaacaaaaacaaaaaaattccaaaatttagcatattagatctttcatttccttagagcaagttttagttagcagttcttttaacagtcccttttagaagggcaatgttcctttttttattcactttttttgtgtgtgtgtggttattgttgtttgcttgattttgtttttgttttgtttttcctctatgtctgtgtttgtaccatatgcatgtagtgcccatggaatctagaaaaaggaagttgcaagccttggaactggagttatagagttgtaagcttctgtagcttctgggaattgaaccctgctcctctggaagagcagcctatgctcttaaccatggagtcatctctccagcctgtttgattgattgttaaagccactgtagaccttgtgggttattgtgtctcatcttcagacgatctctgaaagaaggattattctgttgttgcaattaggactgtggaacagggcacacagctggtcacttgggtgggagtttcagtgtgctgtcctctctgtatttaagctcactcatggaacacttactcatgaagtagtaggtttgtattttgatgaaaaacggtttatccagtcttacttgtttagtcaagaatttgtagaagacaaattgcctcagctgcctctgagagactgttttcatgttgagctgagagctacaggccagcactgtgtctgctaagtgaatgacatctctgttgaatgtgctcttttgttaggctcgtgagttttttggaggcaaaagcagaaagtttacaccgaggggctcatcattatacaggggtaagcagttcattttgtgagactgtgggcccctatcttctggaaacattctgagcagggtctccctggtggtatgaatcctgctgaaagcctgtgttgtgctatatcttcaacactttatgtcatgaaacttgtcagtatgtggcatggatttgaaataagtcaccctgagttcttcctgactagctttccaaagtgccttccttaactaactagatatagcagcccatgactttaattccagcacttgggagagagaggcaggcagatcttggtgagttcagcactagccaaccttatctaattagtgagtttcaaatagccaaagccacataatgagactgtatttcaaaaaatccaaattcccccaaataaaaaaccaagaaaaacaacattatagaaattaaaatatttttattttctgtctctaaagtttctaaaactacaagaacgagtactcaataatgtggtcatttatttgcttggagatgaagaccccagggttcgacatgttgctgcaacatcattaacaaggtgttttatcagtatttatttctttactctttggttgaaatatatagtaagagaatgggagaggcaaaaggaatcccatttaattattttaaaaacttactaaagtgataatttgaaaaaacaaatcactatccttttattataaaactaatgtgctttcattgtcaaatttgtagtttagagatcagcactaagaatgaaagagagttctgcttctttctacctcctggatgtaattgctgtgcacagctctgatggctgtcatgggcataggttgggttagcatctgggaaaaggtgtagtgacgggtgaatttcacatacctcctgagtagatcagttttcctgtcacggcaggcttgtcccaaagctgttttacaagtgtgaccaaggacaagctgatccagttgtggctgtagcgagggatcagagcagtgtctacctgaagctcctcatgcatgagacccagccaccatcacacttttctgtcagcaccatcaccaggtacgctgcccccagcaccttgctttgttcattaacaggatatttatctgagacaccatggtttgccacagccccctgtgacagtttaagtcccttctcagtcacataacggtgatgtcctcagtcttgcaatgagttctttaaggtcttcatctgataattgtatttttgcttgtgaatgtcacatgccatctgaaaaccagtccatggaaaagtttcactcttttagtgaatttagctaatgagtgggtgggctgatgccaagggtcagacggctgtgtgtagtcttgattctcaggcctatattgctagcacatgggcagggtctgttggccacgtaacctcttctacctggccagtagaatggcagagcaaaagatcacagtgaatgtactgggttcgttggaaatctagtttgtaaggaagattgcagtaagagtagtaaaacatgcccttgggacacttgtcttttaaattcttaagactggatatacaggatacctttctttttttgatgatttgaaacaacaaaaacacaactcaaccaaaagacttccaagctcacctggtaatttgttttttggttttttttttccctgaattgggaactcaactcatcaaattttaaagtcattactcctaaatgactctcatcttttctcatggaaaaaacaactttaaaaaaaaaaaaaatcaaccaccagcagcacacggtaatgagtgtgtaggggcatctagtgaaggagaagtcaggccttttttttttttttaatgatgaaaaacttattccagtctttttggaaagaccttttgcatgctaagcaagcgctctgctgctgagccagacccagcctcattcccagcctctggtttactctaaagtcaatgctgctttcctttcttctggaccttaatcatacacgtttaaatgtcatttgatcatgaaaaatatatgcttttagagcctctgcatttttcttactagaatctatagaggctatagcttactgccaagtataacagatgtcaccatggaaaacaatctctcaagagttgttgccgcagtttctcatgaactcattacgtcaacaacacgggcactcacagtaagttttctcgcttgggcttaagataattgccttgcacgtcttttacaatgggaaggacctgtgtgaggcctctctctcttgaggtgctttataaaaaagtgtagttctttcaacagattccaaagtagcacatactcattgtaatattatccaatctaaattgtaaatttatccaacctagaaagtcatcaaataaaagttctaaaatgggctggatgatactggctcgtgcctttaatcttagcacttgggaggcagacgcaggtagaaaaaaacctaatatataagaatccaataatggttatattccaattacaataaaatgctaaataacatatagtaatatgttagacacgtgttgatgtgttgctttggagaaacttaatgatatagagacatgtaacctaagttttaatgttgaatggcagagatagaataaaaatgtcttggaaatgtagtttgattctaggttaaaaaagtaatattcatatgtgtacagacagtctttacaaactcagagaaaggacaagcaaaaaattgctaggatgatttttagggttgtgactaactttcattttcttacatacagttttcaagtattcataaattttctaaaataatcacatgtaacttttaaaatcagaaatagaatattatgcagaattattgtgtaatggttcctcaaaagacctttatttgtacaatggaagaaatacttggacattgttgagagtcacacagttgagatttcagctgtcttctaaatgcctttcaaatttaaatttgttcaagataggagattcatttcaattgtgatctgcacatgtcaaagcatgggtctgatctggaggtttattttaatcattttgagctgaggtcttgagggaggaagagagaaccttctagggagactttgagtctccctggggaactagagttcctagcagaagctgctagctgcctatctgtcagctgtaacagtgttttactgacagttgtgtccagctcttttgtttaaagtatgcagtgtctagtggtaggatgactaccctgtaattgcttactggtctcagttttcatttcatttgttgtgtgtgtgtgtgtgtgtgtgtatgtgtgtaggtttaattcagtaagcctttggtggtgtttgggtatgatttttccattcctttcttctgcagtttggatgctgtgaagccttgtgtcttctctcagcagcctttccagtttgcacttggagtttaggatggcactgtgggtatgtacattcctcagtgtacaagtcagctacccacccagagcaagcacagctgccgggtctctcttttctactccaacttcattcccctttctccctttccatcccctccttttccttttatgttggatctctttgcctcttttttttttttttttttttttaatatatgctggaatccttgtttctgccgtgtgagatgtgtgaaattggtgagagaactgttggggatgctgaagcagttgtgactcttatgaatgtcaggtgcttgaaagcatctttaggggtctgagggtatcatctgtggactcattaaggcattttcatatacaggtaaaaactttctcattagtttgattctttctaaaattactaggtaattttaaagtcagttagcatccagagttgtaatgagctataagagtgtgctctattatgttcccttacaaaataatttctccagtagatggcctactgctgtctgggtataatttagttttctcagcactaataagcaagccttcatttgtgctgatgaccgagaaactttggggattccaatcatatctgaaaggaaatctaaagatttcttctgagtgtaaaatatatggccaactaatggtctcatgctttgtcatctagaatgattgttctcttctttgtgagaatcatgactcaacagttacaggttccagtcataggtcctgcacttttgagcaactttgacattggagtctgctaagtcagaaagggaagaaaatttgaacttcatcagaataatcattctagctctctcaatgaactctattgtgtgatttcatttcccaagtgacttttgtgaagtcgtgatttacaggaagagtgttagttgattagcagttttaaaatgataatggctcacacttgtaacctcagtacttggtaagcagaggtaggaggtttgacacattttgcagcacagcactggctacatagtgtgttccaggccatggggactacataaatgagagtgagacttaagtaacccaaaccacatcaacaaataaggtaaaaaggtaaaatgggtggttctcgggggcattaaagagcaagactgtatgcttggaacttgatttttgactttggaaatgtctgctttcagagtgcccccactgagtgcctctgatgagtccaggaagagctgcactgttgggatggcctccatgattctcaccttgctttcatcagcttggttcccactggatctctcagcccatcaggatgccttgattttggctggaaacttgctagcaggtactgacagagatagactattagactgagttctgatttgctgctaaggggtactcaagttacaagaatacaattgttattttgggagacagctggtttccttaatacagatttgagatattgtctgtttatgtgaatgtgtatgaagggagtagttatgtgctgagtatttttaggtgtgtgtgtgtgtgtgtgtgtgtgtgtgtaggttacaagatgtttaattcagtgagcctttggtggtggtgtttggatgtgattttattttcttccattgcactgtggataaaactgttttgagttttgttttctgggtgctgtgtgccaggcagtggcttggtctatagcaggtagggttgtattcttcaaggggttatagagtagcaggagatgcagacagacaagcacaggagcagcagagcagatgtacacttcttatttggtcagatttataggttaatagaaaaggatacagcaggtgaggtattgcatatgtaaggatttggagaactaaaaagttatttaatattgaatataagttactgtggatatcacctgaggacaggagtaagaatggagaatacagccagccaggtctgaaaccagtgaatctacttggggatagggtaccaggtcttagtgaggaatattgacttgttctgtttgtcattgatatgttttatggagatctcctgacttgagtttgggctggaatttgtagggaggatcaggtgtttatgggaaaagactgagccaagagtgtactttaggtgtagagaaaggggatagaaagcataatggaggcagcatccccaggcctgatctccagctgcatctcgattgtgaggatcacacccatagctggaggagagtggtgactttgtggaagattgggttttgggggccaaatagcacttttatgtaagtttgagacatctgtttagatgtagaggttcatccatatgttagcacagatcagtgagaaacttaggccacaacctcttcccacctaacacattgcgggtagagtaatgtgtgtgcctatgtctcagcgagtgcccccaagtctctgagaagttcatggacctctgaagaagaagccaactcagcagccaccagacaggaggaaatctggcctgctctgggggatcggactctagtgcccttggtggagcagcttttctcccacctgctgaaggtgatcaatatctgtgctcatgtcttggacgatgtgactcctggaccagcaatcaaggtaactgttccttgggggcagccattatcatctgcctaatgactggacttcctgaacatcatgctagttgtctgtttcttctctatttcttgctataagtaaagcttattcagacactgtatttaacataaagatgtagttattttgttttgttttgttttgatgtcagccatgaagctcagaagtgataatttccctttaatccccaggttccttcacttgctttctcttccccatcacagcaaagtctttgaagaatcatcctagtcacaaagtccctccatctgctcaggcatggacttgtgtgttgaggtctttggccctttctggcaggaaggaccctgttccccttcttgagccatccattcttccactccagtctgtctggcttctgctgccccctttcagagtacttcctgctgcggcagtcatgtcagttgtatggattctttgacagccttcctatcctctgggctactttttaccccaagtgatatggctttctgtgttttttttccaacatcctctactgttgggttcagtttttcttgtccactgttaaaggtgctgtcctgtggatcatctactttctttttattcttgactttctgctctagcgggaattttccatgtccataccagccacaacagtagtcactgaccacatgaggcacttgtgtttttgaaatgtggctgtgtgacttaaactgaactgactaaatagactattgaatcaggctgccgatgtgcctgcatcctttgggggctggcttcaactctgtggaaccttagtcctgtgtgcctgctatattgtagatgctctgaggctgtctcacatgtgtcagaagcctcagccagagcctggccttcttatcttcttccctcctctgaacctgcttctcttctcacactttgtactttatcaggatagcaacgggagccaccatagttttatttcagctcactattctttatttttcctactaaatactttgtttaaaatttatataaagtgaggtggtagtggtacatgcctttaattctagcacttgggaggtagaagtagatctctgagtttgaggccagcctggtctacagagtgagttccaggacatccaaggctacacagagaaaccctgtctcagaaaaaaacaaaacagcttaagtatacctacatatatgtgcacaaacatccctttggtgttagtgtacatgttcattgattcataccttctcttttctggattctggtataaactggtgtatctgcactggcctatttttggaaatcatattattgaagtaattcatattccataacattcaagtatacaatttaattttgtttgagtctaggccaactgacctgaaagttatgtatcccagactgccctctgacacatggtgattctctcagttcaacctcccaaatactggcattgcagtgtgagtcaccacatggtggtggcgcttgttatttttgttattgtgttgttgttgttttaaattataccacagagttatatggacatgactacagtcaaccctgtaactgtaactgactccaaaaaccttccatgcccctgtctctggatagccattactctgctttttgtctgtgggtgtgcttctcccggactattttgctgatggcctcatacacttggtggatttgtcacaggttctttataccaaaaatgtcttcagtttgatagttcctcacctgccccctgcagccttcctgcctccttccatgcactgcctgaccacagccattcatcctgatatgctgcttgtcttgtctgcttgatgaggatcagaggtgcttagtgactcacgcagtctgggctaccatcattacagagcctcagtggctacttattctcccagttctaaaagctgagtattctgacccctggtaagtctggccttctcatggagaatggggaatgggaactgctggagtctcttttcataggagcaatgatcctatttatgagggtcctgcccccatgacctcattctgaagctcactcccttctgttgcatgctcttgatttcagcagatgagtagggcagaggctgaggccagaaagggagtgaggagcacagcaaagacctgatgtgcctgccttttaccatgttgtgtctatcctgtgccacctttcttctttgtgtgtaggagcctgattgtcccgtgtatccttggggttgcatattggagagcatgggtcacatctgggctgttgacttgttgggttttagctatcacattgagcaagtggcttaattcagaacattgtttcctcacttaaaaatgaaaatgtaaatgtttcactgtgcttactcatgtgatgttcacataaaatgtcctgattgccttctcttagaggggacatggccggggtgccagtgactttaggtccttttaaatccctggaggccctcccttctccaacccattctcagtgctggtatgaggaagttcagagccatgcctgccatgtgcagttatgtgggtgaaagtagaattaattatctctagtatcccagctctttagtaggagctcaaaggccatgagtagcctgagctagtactttccaatatgtggttgaactgtatattagtatttttagggtttggctcctgtattaattttatcccattatatatttttttattttaggcagccttgccttctctaacaaaccccccttctctaagtcctattcgacggaaagggaaggagaaagaacctggagaacaagcttctactccaatgagtcccaagaaagttggtgaggccagtgcaggtaggaaggcgtttctggagggcagagggctgcctgtggtgcaggagtgtaagcaccgtaagtaggaaagctggtcctctgcagtacagtcagggaggagttctctgggtgcttcagaagtgtctgtggtaaactgtcactttacagagtcaagccatagaaaggagcctgcttttctgtgcttactctccccttcttgtaaggaagaactccgcattattattaaagaggcaaagaagatgtgtaggaatagatgtggatggtgatagtcaaaaacaaacacaacaaatgatgatggtatgggaagcgttctgataaggcaaatgaggaatcagttttgggagaggtaacaagacagtggaagccagagatgatgtatctttaatctaaccctcagaaggcagagtggattgagagtttgaagccactttggtttatgaagtgagaacttacctaaaacaaagaggacagtgacagaaagacacagtggagatagtcatctgatttggaggaatctagaaatcacacagatgtttggaggggcttttgtatttggggagatatcaggtcaaagggccagagttttgtcatagtcgaagtaacagagtcccatctatgcccctttgggatgagaagcagagtgatgcctctgtcttgtggctactttctttctgttcatgttcatctcacagcaggctttgtagacaagtacccaaggagttgaagggatctgcaatcctataggtggaacaacaatatgaactaaccaatacccccccagagctcgtgtctctagctgcatatgagtcagaaaatggcctagtcggccatcagtgaaaagagaggcccattagtcgtgcaaactttatatgccccagtacaggggaacaacagagccaagaagtgggtgggtggcggagtgggtgggggagcgtgtgggggacttttgggatagcattggaaatgtaaatgaaataaataccaataaaagaaaagaaaaaaaaaagctacggacttgaaaatgtaactgatgacccctcaaaccaagccctccaagtgagaaagccttagaaatttagatagagatgaagagcaggagactgctctgcttgtcacttggctctttagtctcagtgtagtaatgtatacaccctttacagttttcaaagcatgtccacagcacttaatgaatatcccagaactcgtttgtctcaaggtcagccccatgtacctcaggagccttacttagaccaaggggacctgtgtttggcttcagcccttcggtcagcagaggacagctgaggccacagatgactccatcagctgatgcccttctgcccaccattcctttccattcttttactctcaggctcttaggattttactttattccttactacctcccagagcacatacttcagaagtcaggggaaagacttgaatgtttctgctagaccattctgaaaagttatcattgcagtaattgctgttaaacttaggaagttttttccttagatttaaaagtttaatttttgggttttggtgtttttgtttgtttttttctaagcctctcgacaatcagacacctcaggacctgtcacagcaagtaaatcatcctcactggggagtttctaccatctcccctcctacctcaaactgcatgatgtcctgaaagccactcacgccaactataaggtactgctccttgcttatttctgaacatgtattccagcgggatgcatgtccatgtacccatgttcatgcttacatagaaagaagccctgtaacataggatttaaattttgcttctcatttgtcttctaggtttatggaagctttacaaatatttaggaattttgtatgagaacaaagatctgtggtctctgggtgttgtttgtttattgtctccccaagaatacttggtttagaaagatatgcctcaaggactcctggggctcagtacagagtcctgtttataggtgaggctcattgccatgtcctgaagacacacagccaagccaagcaggtttcatgtgccttctccctctatcagccttaaaagatagtgcaactgcccaactcaaaccaaaattgtagcttccggagagaaaagcagatgctcactatagacctataaccttggtgttcttgtcagctagggttttctgtcagtgtagggactcttttgccagatggtcctgattcagctttgtattggctattggatgattgtgtctgggtttacattctttttttttccccatgattatcccagcattaaagaatgatttgtagatttacccttattgatttgaaatcctatttttatcaaatgttaagatctcatgattgtatagtttcatttatgtttttgttacatcagttgttcactcatttaatagcacattttaatttttttatttaattaatgaattatttttgagactggggcccaagcttgactagaactggcctcaaacatcagtgtctcaaactcacagtgacccacctgcctctgcctcccaagtgctgggattaaaggcatgagacactatgccctgtagaagcacattttaaaattattgtggtttcctgatataatccccatttttctttagaattttctggatattacctatttttacatgtgaaaatttgaatagactgtctaattctaaaaaccatggaaattctttccctttaggatcgtgtctgctgtgtgtcttccctcagacagagctaatctaagggaatggtagactgagatggatgttttgatcacaggatacctttctgtttgttaaagctcctttccttacctcagaaatctgagagttaaaagaatttttaaaagaacttaatagattattcacatagccctggtatttcttactgttttccaggtgtgcagctgcttcattgagaactagtgataatgttcagaacttctgttcatgaactctgtcagcccatgtagaggagggcacatgtggtgcttgctgtttgtgctttcgtcctctgtcattaggagccctttcccatgcttcccaccttgatcctctttttgtactgaaacctcaagcatttgcttttagttttggcctccccaatatctcagatttctgttcctttgctctctggccctgcttctgtaactaactcttctgtaacttttaagtgttttgagtagctgttctgccgtagtgtgtcttcttaccttgtctttccttcactcttaactctgagtccctttcactacccactcctctcctgcttcctcttgttctatttctcctcttccccttctatttcgccttccttgttgtctgtgtcttagttagggttttactgcaggcaccatgaccaaggcaactcttacaaaggaaagcatttaattgggactggcttacagggtcagaagttcagtccatatcatcaaggcataagcatggcagcatctaggcagatgtagggctagaggaactgagagttgtacatcttcatccaaaggcagacaggagaagactggcttccagtcagttaggacaagggtctcaatgcccacccctacagtgatccactttctccaacaaggccatacctcctaatagtgccactccctgggccaagcatattcaaaccaccacaattgggaaagaagcatgatgggagtgaagccattcctcactaggcctttgatcccacatataacatcactgcattgttctgggctgtaggatctcaggtctctctcactgctggtgtcccttcctgtccctgacatactgaggctgattccagtgcaccccagacctagacctgttagattatataaaagcagtgtagagagacagaggatggaaagaaataggcagaaccatgttcatggcagaggagtattttgtcacctacaagtgatgcctaaaatgtctgtagaagataggatgctgccccttataggccagaaataactctcatagtctgcaagggaagctgggaagtatagtctttaagtggcaaaccatcattcctaactcttaagatgatataaaaaattcagagcaggggagttatgtatagctgtttaatgctgaggagggtttttgctggaagcagtagttttgggtctaatgaagaggggttctctggtcatgtatcagggagagtcttaacttgattagctgaggtggatcgggctgttgtcttatatttctgaagagacttggaaaataattctcagagggcagtaagcagatgacatggttacagagtagaagtaaaagatttccaggaaggttgaggagtagggagaagcagaggtagagtggactggtaagagacagtgaggatagaatggattcagggtggcagtgactgcttccattagcataagtagcagataactagagtagcaaaggaaggaataagaaacaataaaaagactctgattaaagagttgtacccagccggccatggtggcgcatgcctaaatcccagcacttgggaggcagaggcaggaggatttctgagttcaaggccagtttggtctacaaagtgagttccaggacagccagggctacacagagaaaccctgtcttgaaaaaagaaagaaaaaaaaaaaaagagaaagagttgtacctggcctaaagtgaaagggacgatgttgcttttagtcagcttgcctcagtatctaacagatctttttatagatatatcaggagcaaatgtagctgttgtaggatgagggctattgggaaagcttacgtcaaatatttagtttaggtgtaaggtaaagttcagtaagcaaaacatttaaaagacaggtcaaaacataaatataagtataataaggagaaaaagagtgatctaggggaggaagcacggtgggagggaaccagaagcccacacgtaggaataggcttgtagtggacgctttttcaaagaagttaagatttactggcctggaaacagcacgttcatagaagagaacacaaatctcatcccagtgttagacctagtccttttaaattttgaagtactgcagcagtcaaggagtcaagctggccctaaaggatatttaagctgatcagagctgatgagacagaggggttaatagatgcaaatgtctagagtggtaagaagaaagatgagttagatggccggtgcccattagttccctctcagaggtgacccagattgcttttatgggcttaagggggtggatctttataactacctcaaggctgacctctgagggggcagcagttagagtgtctcagatgagggtccatccaaggggccacaataaaacctaacagatgacaaagatgtagggcataagtcagaaggtaatgactgtgcaaccttgtgaggaaattaagagacaaaagttaaatgaataaaactttgccatcaagattaacatgaatcaaaataaggttaaattataaatttaacataaggttaaatgcaatcatacaactggctggaccatgtaccagagctatgtagtaggataaagtaacttttgttagccgttggcttatatcagactcctgaatgaggagagagcactcaggacctttggaaaagatgccagttaaagtcagggtccaagggaagcatccgaacagagcgtctccgtgatagtcgctgctcccaagtacgaggaattttgtatgttgtctcaaatattaataataaggctattatttattgttgcttagttccttgagtttgtaagctttctattgttttgttgttgatatccatctttaatccatggtagtttgatgggatacaagaagttatttcatttttcttgtatatgtggaagacttgctttgtatccaagtacgtgtccatttagagaacgggcttgagaagaaggtgtgttctttcgtgtttggatgaaatgttctgtaagcatctgttaggtccacttgatttctaatatcttagctccaacatttctctgtttagtttttgtctggatgtcctgtccgtttgtgagagtggggtattgaagttttccctataagtgtgtgagggtcaatgtgtgatttaagtttcagtaatgttcctttcacaaaactgagtgcccttatgtttggggcatatgttggacatagtcctgagttcaattcccagcaaccacatggtggctcacaaccatctgtaatgggatgccctcttctagtgtgtctgaagacagctatagtgtactcacatacataaaataaataaataattcttttaaaaaaaaactgaaatgtcatcttggtgattttttttctttgatgagtatgtagtgtacttcccatctctgtgattagttttggtttgaagtctatcttgttaaatagtaaaatggctataccagatcatttacatatagatcatttatagattgcttcatagatccatttatttggaaatttgtttccattattggggaattgagaccattgagagatatcaataacccttgattgttgattcatgcatgttatttcttgttattatggtggtggtggtggtggtggtggtggtggtggtggtgtgcatccattttgtttttgctggtgtgagattgtttatttcctgtgttttcatgggtgtagttaatgtccttggatttttcttctagcatcttcttcagtgctggatttgtagattcatactccttaaatttggttttatcggagaacttcttattttttccatctatggtaattgaaacgtttgctgggtatggtagtctgggctggcatctgtggtctcttagagactgcagcacttttgttcaggctcttctgggttttagggtttccattgagaagtcgagtataattctgataggtcggcttttgtaggttacttgacctttttcccttgcagcttttaatattctttctttgttctgtatgtctagtgttttgattattatgtggccagaggactttcttttctttcttttcaggaccaatttatttagtgatttgtatgctgcttgtacctttataggcatctctttcttgaggttagaatttttttttcttctatgattttgttgaaaatattttctaggccttggagctgggtttcttctccctcctctattcttactatccttaaatttggtcttttcatagcatcccagatttcctggatgatttatatcaggaaatttttaaacttaacattttctttgactgatgtaccatttcttctgacatcttcaatgtctgagcttctctcttccatttctcatattctattggtgaaccttgccatgtagtttctctttgagttcctaaatttttcatttctagaattccctggtttttttttttttttttttttttgcttctatttccattttcaggtcctgaatagttttattcatttccttcaactgttttttttattgttattgttttccattttcttgactttcttttaagatattgttttcattttttccaattgtttgtggttttctggcattatttaagggacttacttgttttctctttaaggatctctgtcaacttcatgtagttggttttaagatctttttcttgagcttcagctgtgttggaatattcagggcctatggtggtaggacaggtgagctctagtggagatttattgttctggctgttattgattgtgtttctaacacaggcttctaggtgtctgggtttggtgtgattataggtctaggtgctgacttctgtgtttgtctttgttggttgggtgctttgttgcttgtttctctggtgtgttcagctggtgtgttcccagagtatgcctgatgttgttggaagctgggatgtagtgaagagtagcagaaggaggtcaggaggtgatggtccatgggatgcatgccctatggcagcagtggggaaggaggactgcagcagtgctagggaggagacggaggtttgtggcaccccacctggttttctgacaagcatgacctaggtgagcaggaatgttgcccaagttaggggctgggattcaacaatgaattgaggaagggaagccaggagaagatggtctataggagccatggataggggcaagaaagactgcagctggtgttggctgcagtgcttcagaggagactgaagagttggctctaggtgaacagagagttctaaggaatttcttgaacctgggtgtgtcctgccagtgtgttataaatttaattcattttacttaagcattctcttttcattattaattttatatacttgattttgaatattgttctacattaatttaaacactgtaagtttactttaaccttgttttgagttacctgtttcaggcttaattttgacaatatatacagaatattaggtgatagaagatagaagtaactcaagctcggttgtgatggcacacatctttaatcccagcacttagggggcagaagtaggcagatctgagttcatacagcctggtctacagtgtgagttccagaatagttagggcttcatagagaaaccctgtctataaaaaataaaatgtaacaaaacaaaagttggtttttccctccaactttatattcctgtaaatgaattaatttttacttagcatgactacaaacatagttctgagcacattgagtaatttgttcatttataagataaccgagcattaacttgtatatcttagttaattaaaataatttacaatatataagattagggttttataattttatatctgatatgtttaaacttacatgtaaaaaattacacatacacacatatattttttaatatcaagtaaactttaaacataaatacagtccagagagactggcctcttatagtgtacttttatatcagctttttatatgatttagtttctccaaatagctaaagcttaacaaagatagcaaaaatatcacaggtttttttggatgacccagttttaagacaaaccatcttggaagcctggtgttgccttgttagtccaaaaaaaataggatacagtggtaagcagagggatatgacatacttagctgaggtcacatgtcatactttaaccctgatgaagtcaccaaccaaaatgttgggaaggtgagcccttctgcatttgccttctgcatttctaagctagagttgaatccaatttacatacatggtatgctatagcacattaaggttagctgaacatagacttttacctattaacccttttttgttacaaattttaagttaacttttgtttggaattttaaaccatacttaatgaacttataaatcctgagatgcagaactttacacagtgctcttataaagcctgagatgaaagaaggtctatactttagtaaagttttagagctcagatttcccattggcaccatatgttaaattgttaaaggaattgtagagagatggatggatggatggatggatggaagggagggagggaggaaggaagaaaggaaagaagaaaggaagggaagggaaggaaggaaaggagggagggaagcttggtttaaccttaggtgaccacagtaaggggaatatttttgtcacccacatgtggggatggccaaaatgcctagagaagatgggataccgccccatactagggcataagtgacttccatagtcctcaagggtagctggaaagtgtagtcattcaacaggaaactatcaagacccattctcattttctgttcagtatcttttccctgcatttgtccagtattctcttcatcataggaggttaggttcaagttcagtggacagattctcttgtaaagttttttgaactggttctttgcatgatcagcccctcccctgccatcagaatctgtagaaataggggaattgttatagacttcagttaagccaaagcttttagaatcttcatcatcctaagattaatttgactacatctagaattgacagtgaccacctcccacccccaccccacccccgggatggtgagagtctaggtcagcatgaagaagcacctccccgcagcagacggcatttgtgtctttgttgtagataaccagacttcggtggtgccagtaaccgtgtgctctctccttccaccttgccaaggtcaccttagatcttcagaacagcactgaaaagtttggggggttcctgcgctctgccttggacgtcctttctcagattctagagctggcgacactgcaggacattggaaaggtttgtgtgtggtctcttttccttgaacctgggtcagagtacctcagatgatacctagtcacatggtgtaggcaggggagactgcatcctatttgtgtcctagtactacaggatgccagggcacctgtgttaggtctgttaccagtgtgtcaggtcttattgccacagtttttcattcagtctagaacatgttgaaaatttgcttacagaatccttcttctctcccttgagcttttaaatggaaagagacaaaaccagattaacaaaggtaactgacctactccttccatagcccagaaagcagatctaagctcattcatgttctgtggttctgagtagaataaatcttcctcccagcccatatgctcacacttaatcctgccattgctaacaattttgcttgcactccactagaacatctcgtttctaatatactccacagtgagttagacagccatcttcaacttacatcttcaagtgaaatatagtccagggcctgccaaccactgatgtcaaaatccattcatgctaacgctccttatatgaaatggtatcaaattttgaaagcctacccacatctgcttataagactgagtcatcttgaaatgatttacagcctcaagcatttgtaacagttccgtgtagttgttattctgtattgtttagggaataatggtaaggaaagacacctgcacaaatccagtacagattgaatcctgcttttcttcctcatttgtttgtttgtttgacccatactatcaggcaacacactattttacattttcgtcccttcattgcatgcagcagtgcctgaactattaacattcatcaaacatttggtcagtaaacagatactcttttcaagaatcagtttgaaagttgggtatagtgttcacatctggtaagctaggtataatggcacatacccctccgaggctgaactgggggagctgtggtaggagctaaaagacaatccatatcaaaagcaaatgaacagggaaaattgatgtgagtgtctcatagaccttagagccgtgctccatgtatgattagtctgtgtcatcacatgacattgataaaatgctttccttttcccactgtccagatcttgttattccatactaatttttatacataattgaatgtattatgtgcgagttttgcttagattatgtataatacacatttccccacatatctccttactgttctgtattgttttcctatgacttctcccaagacttcatactatttttgagtgattttactatgatttagcttgatgtggttttcctttcagttgtgtttcttgtactcaggtttgttgcgtttcttggttttgggcaagtatagttttctacagtttagaaaggttggggctacttccttatatctctccaaccttttcccctcactctatctcttaattaccttctaaaaacccattcttggttacttaaaattgctcttagtttactgttgctctttttaaggatttgggtttgattattctagattcatttttaccatttttaatgtgtttgtgtgtatgtatgtgcgtgtgagtggaggtgttggcagaattcagaagagggcaccagagctgctgaagttttagttgttgggagttgtgagccaattaatgtaggtgctgggaacccaactcaggttctctgcaagaaagcatcggctcttaactgtctttccagcccctccttttaggtctgtttgtttttaatcactatctacttttccttttgtagtttctgttacagtctttaggttctctaagttttcctttccccacatctgctctactataaaatcccatctgttatatcttttatcattaacattatagcctttctcactagaagtttgattatttcttttcaaatctcctatctttatttaacttaaattatttgtttattatttatttgtgtgtgtgtgtgtgtgtgtgtgtgtgtgtgtgtgtgtgtgtgtgtatacacacgtgtttgttacgtgggcacctgtccacatggaggccagaaaagtgttagagtcctccactacaactctcaacctatttctttaaggcagagtctttccctaaattagacactcccattttttctgctgttctggaagccagcaggttcagccttgtgtgagtgcctactgctccttcaagttcttctgatgattgcttctcaggccttggttttgttagctcccttagtatctttgaagtactcaaggaacatcctcccccaatctccaggggtctctgaatgacttgttttcttggtgccatatcatttgagctgccattttcttggggtctttggattcactgtgccctcacagcttgccttctgtccccttgttgtgccacagcctgggaatgctctcagatccttatctagggccatcctaggactttgtctgtattttattttcaggatcactgatatctatggcccgatgttcagtgtttgaaaactatgatatcaaagctggaatctttaaaatacattttttgatcatttcaggcaggagagggtaaatgcagagatggaagtctctcaatattacattgtatagtgatgcctgtggtagtgtcctgattccctgtaaccctggagctcctggaaggacaggaattacattctttatctgtatttgcagcacctggtatcatttctacagcacacaaagtgttctatacagactgtggtgaggctcattggcagtggctctcacagtgttctgttcagccgatcatatttaggactctacaagtacagggcttttgactcctttgcacactccataatgcctgccctgaaaacaggtattagatatagatacttgattatttactgaatgattgggtgacagattggttgtgtaaatgtacaagaaagcagtttttacacaattgtagatacaggagttcttgtgattgttaagatgattaattgaaagcattactcagaatttctctgacatttatatagtttatatggtcactgtctatttctgagtggcaacaataatgggtcacctatgagtcactgatgttgtcctcttcctttcacagtgtgttgaagaggtccttggatacctgaaatcctgctttagtcgagaaccaatgatggcaactgtctgtgtgcagcaggtgtgtgtcatttcctatcttttgggatttgagctaacccctttgggccaagtgacaaagcctagttcctttttggaagctggtgctgtggtgtggtatgaggaagagtttggtgcccctagctatcactcccgcgtgctctgtgattgggactgtggggggagagggcatcaagaagcagctctggccctcactgcttcgcctttgccaccgcaccccagtgggcttgtttctcttagaaccacagagaatctcaggcacaggggaccacatggtgcgatggatcttctgggatgctaactcctagggattcacaacaaagccttccatcatacgttcctgctggatttgctactgggaaaggattgtcccggcggatgtttacttttgcttttgtttttttcccttttattttttcattagtggtactaatggttgaacctggcttatgcattccaggaaagcactctatcactgagacttttaaatttttgaaatatgatctctgtagcagttcccagttaatgctactcagtcgatcttggtggctgtggtggtgctcctccttgctacccacccaatattttgggttcctgaatgagagacacatacatgcagcctttatatttttatatgtcttaaacacctcaagaactgaaccacttcctaaccaccatgtggctaacccaccctttgatatccccgagttattgcttactacatctatattttatctttgctgccctggacccagatgtgtagtcctcttggaccacaatcccctgattcctacatggtggctatgttctctgtcaggcatggcatcttggttcttcctctcccaacatagtggatctctctttcctttctctccctgtccccagccctggaatcctaaaagtcccacctctgtatgccctgcccagccattggctctcagcatctttattgaccagccagaaccaactgtggggagggtctcttggtgtcttatgtgtgaggacactgcaaacaggtttttaacatgattagcatacaagcatgcattagaccaaacccacaacatttccccctttttgtccattaaaaaggtcttttctctcagatatatattgaacataattataacagttatgtaaaatataaggtatgatatatattagtgtccagtcattcaattttgtcagtttaaataaattattctatcatctatcgtaacctaagttgcccaggctttcctggaacttgcagattgtctatttccatcctgaccactgtctatcctaaccgctgtccactagctggcattgcagacaggcctgtgctgctcatctacattaaatttatattaagtgaagtactgatgtttccattctttcattctagctattgaagactctctttgggacaaacttagcctcacagtttgatggcttatcttccaaccccagcaagtctcagtgccgagctcagcgccttggctcttcaagtgtgaggcccggcttatatcactactgcttcatggcaccatacacgcacttcacacaggccttggctgacgcaagcctgaggaacatggtgcaggcggagcaggagcgtgatgcctcggggtaatatttatggtgcaagtttgtcactgatgatgcagacacgagttatgtgcagcccttccttgaaagtcattggctgagttatggtgtagtcagctatccagaggtgacaggctagagaggaggaacccaagctgcctgtgaagcataggttctaagttccgaatcttgccctaaactagaagtggcacactcactgtcctcacctgttgagagtgtttggtacttgcagtgtttatagtaaggtggcttgtgtcagtggtgcttctctatgctgtgactcagaggaccaccttcaaaatggcacacagtggtgctcgtgtttagaagtattgaagggcataaaatagtctggggtgtgttgtttttttatttctatatgaatttatgttaatctttttcagtagctgaaatttggaagtccttccgtccctttctccttcccttcagggctttatatggtaggcgtgtactttaccactgagctacattatagccctagaaggtgttttgtaaacttctttaccataattatcaaatacttgagatgttactcagtgtagtaatgttagcagcattcttactttccttttttggatgaccagacaatattggaatcaaggaaaatgctccttttcttggatttatcttggtagtgtgcttttatgtgtgtgccataatacctgctttgctgtcttttcaaacattttatgagatggttctctctctacattgcctaggctgatgttgaacttgtgacctccatcagtcttcccccaagaaaaccgaatgatatcacctatctttgagttgattttcacctctctcaagccctcttagagagtgtgctgggtagtgagttttctgtagcattgcacactcaattgaatcctcttgtctctagcacatgctactcctaaacccaatggcctttctaactctcattttgaaatgatctgatttttttgaacatgaagttgaattgatgtatggctgagtagtacaggggagatgattaaagatatttgttttctgctttgggccatttggcaggtggtttgatgtactccagaaagtgtctgcccaattgaagacgaacctaacaagcgtcacaaagaaccgtgcagataaggtgaatggcactgcagctagagatgacatgcggatatcactggggtggaaacagagctcagacttttctagattagttgccagaagattctaattgcaactgtggtttctttcactttttcctatagaatgctattcataatcacattaggttatttgagcctcttgttataaaagcattgaagcagtacaccacgacaacatctgtacaattgcagaagcaggttttggatttgctggcacagctggttcagctacgggtcaattactgtctactggattcagaccaggtttgtctctcggccttgtagtcactatactttctcctaactgaatacaaattaccctgaaaagacaccacccaagactggcccgtactccagtggggttaggctttagaaatttccacaagttttctacatctgtatacccactcataactttataataagctgtctttaacttgtaagatagaattttagatttattctggtgggccaggtcatttatgcaaaattcagatttctgtaaaacaggtgatcatcagccaaacagtggtggcgcacgcctttattcccagaactcgggaggcagaggcaggcagatctctgagttcaagcctagcctggtctacagaatgagttccaggatacccagggctacacagagaaatcctgtctcaataaactaaaaataaataaaacagaaacaagtgatggctttgctcagagaagcttctttctcagaggacagtggtcacataagtaagtggtcgttgagtactcaaccctaaatgggacatcaggcctcctctcccctcagggagcactgctgaagagggggatggaaaaaagagagagctagagggtagggaggaatgctgtgaagtgtgaaatgccagagctgtcatagtcacgaactcacagcagttgtggtcacctgcacaagatcaaaccagtcaacctcccagcatgactgatgttggggctcagctgatggctgtttggggaggaatgtcatttttctttgcaggggagtagcacataggcagcactaattcaactcaatggattataagaaaaataacattaaaacatcaagatatcatttacagactatactttcaagcactgatgtaatcaacaggcccaatcacttttacaccattctgggggctgtgtaacttggatcagaacccctcttctcaaactctccttgccttcctcttgcagttcctgtggtcataaagttccaatagtcctgcttgtaatacaaattctattcctagggagatcttctatccatgccttcactgagaagaaattatctttaggttgttgaaaattgaccatcatttttgtgctctgattgtggcctaccctttctgagtgagttactaggatgagccagttggggagactccttggccctcttaggctcatggtcatagtgcaaaatgtatttagttcaacttcaaaagcatttatagtcttgcagtcggaaagtacaaagtcctgtttgagatttctcaattgtaatacccttggatttgtaaaatcaaaaattacatatttctactatactatgatgtagaatatacattcccattccgaaatggaggaatggggatatagtgaggaaatactggaccaaagtaagattgaaacctagcagggcgaactgtaagacctgaagttagcctgtaagccccacctacccaaggactaggtaacttcccggaatactgagagttgtagtattacaaaaaaaacaacgccacattggggcgagcggggggtagggggggtgagggggggtgagggggggaggaacagatggcctttgagtttgtccttttgtgagatagagtcctaccacgtagcccaggctggcctcaaacttccatctggctgccttttgcccaagtcctgagaacttgcctgaggctataattaaaaaatagacaaatttctttgataaagtgaatttcaaagacagtataacattgagtctgtggattggttattacagataccttatgcaggtctacagtgaaaaagagcaattaggatagaaagagataatagagtttggagagaaaaagagcactgggaagttttgcgttccacctcactcatgcacgagctagggtagttggcataggtaagtgctgttaaccagaggcttccaggcctacatctacctgtctgccttgaccactgtgttcccaaaggcatgactgaaggcactctgcacttagctgacttcacagtagctttgaaaatgtggttataaacaagctaatcttctgtgtaggggcttgggaacagtacacagatgggttgaagaaatgacccccggtttttgtgtaagcctgtgactgacggcagcttttctctccctgcattaggtgttcatcgggtttgtgctgaagcagtttgagtacattgaagtgggccagttcaggtactgatgcttagttacttgagttgttgtccttgttatgtacacatgtgcagccctaggtccttacagtgacaggtgctttccactttcacacatctgaccacttgcagaaagcctttctcaagacttgcttagaaacaggtctaatctagccattagtgtgttttcatttcacattcatagtatgtgatgatggtaacatgtcactaagtgccatcttacccagtgggtccctgttccctaactttagaggaagcacttttaggccgtggtttagtaaagggagtgattgtggtctttagttgcattatctgtagtttttcttgttggacattaaagttttaataatcttgcagtatgtataacagatttgcaatttttgaaaattacagttcttagcaagtagtttgaaaggcgcaacaatggagagttttgtgagtttccctgagatcgagactcagctcttgttctgattatgtgacaccttgactctgtagttttaaccagggaacattttctcctcggtgtctgaattttttcaggagaagaaaggaaagtgaagagctagaaaggtcttacctgctagcatccagtgcttaaggtgcagcttcacaccgtaaccatcaggctctccatgtggcagaggcaggaagaccaagggtacgggtgggactaaatgaggtctcagagtctgctttaatttaggactttctcctgggcttgacttgtaacttttttttttgtatatgtagattacacatcttattttttaaaaaagaaatgtctaaatgggtgtttttgtttctagggaatcagaggcaattattccaaatatatttttcttcctggtattactgtcttatgagcgctaccattcaaaacagatcattggaattcctaaaatcatccagctgtgtgatggcatcatggccagtggaaggaaggccgttacacatggtaatgtgtgcatctctgcttgttgtcctcggtcatccactttgactgcaagtgctgtgtgtatgtgtatgagggctcgtcatgcgtgcacatgggttagagatgtttaagaagaaaaaaggaacacattgcttactcataaaatttgtaaactacttgtagaaaccataaaaaatagtgacatcattaaggtatagatagattctgatatgtgcctctatttatgaagaaaaatttttattttaccatctttatttgctttggtcttttttttagagagggcataggctcagatctgggccctcacatgtgctaagcagtttacctccaatcacaccctaaactcacaacattttacatctagcttgtcacagtcaaattttaacttttgtgttatgttttgtcttttgtttgttggttggtttgttgtttgtttttcatttgtaaaaacttgtttggagtctgatagctgtctctcatgagtcatttccacctgtggtctcacttgctccctcttcgcgcctatagctatacctgctctgcagcccattgtccatgacctctttgtgttacgaggaacaaataaagctgatgcagggaaagagcttgagacacagaaggaggtggtggtctccatgctgttacgactcatccagtaccatcaggtaagaggaaagcacagggatacccacatcacagcatggagagacacgccatagccgggtcctgtgtgtggtgagcagtctcgggaacactgggctctctggcgcgagggagaaagtgcactaggctaggagctggcacagcccagaaggctagcagacatatggctgaccactagagtttcagtcgagatgctaatgtcacaggggctgtttattctcaaatgtagctcaaggatcaagtaattgacagtgttaatctaaaccattaacattttaaaaatagtaaaaccgtcaaatctgaaataagtagatagcatatttacctctatcttaacgtagtcatggtttttgttttggtttggtttgttgttgttattgttgttgttgttttgagacaggatttctctgtataatagagtcctagctgtcctaggcttgccttctagaccaggctaacctcaaactcacagagatttgcctcccgagtgctgagactgaaaccatacaccaacgtgcctggccagccatgttttttatttgtgctcatatagtcttgtgtctcttaagcatgagcatggactttacatgcttcaatcagcccatgtgtagaaatagtttttaacatttttgtccttttaaaacttgtacttttgattattcctcccttattttgttagctcctttcagcagcctgtttctgaaacttcataaaaccacaagcttttctttttctttttctttttcttttttttttttgagacagggttagcctttttcaaagaaacagtactttctttgtttcatttatgttttgatcaatctttataatagttaattaaatatttaatgcttagttaagccaaggcataaagtagtttgagagtaagcacatgcctttgctaagcacagtggagctagtagtgccttgggaatagtatacgccttgtgcatgctcatcagggtctgccccgtggagatcctcgagggcccaggaaataagggcttgtgtgcataggcagtgtacatggaccttgaagcaaggcagctttggggataaggtagttgggctaggcttaacgttgtatattgtctctgaggtggtgtgcattttttggttttggtttgggttttttgagacgaaaagaacagcttagtttttgtggacttcctgatctattgtagcacagaagtgaatacttgaccatgctcctctaaaatgctatctacaaaatgggcagtgggccagatgtctctgttaccagcctttgccaggtcacaggtttatctatttagaatgaccaaaatgaccaccagtaaactcacactcagctttgtatgactgttggcaagtgagggccactcaacaataaaatgcctttgcaaagagcactgaagtggatttaaagtacataggaatattagattgttccacagtatttagtcaagggagtgtttgggctctcctacagattaatgtaagtttgattttcacttgatcccttctttatgaaatgtcgaaatactcatcatgagtcttccggagcccagcacagcgcactcatccccttggaggttactgcatctcttctatggctttttgttcccttcacattcacatttcacagagtgaagattgtgtgctttcctcggtcttccctggggattatatctctttgaaccttagagttaccagctaagctgggaccggtgtggaacatggggaagttgagggcccctgggccaggaagcattctgatcctacccaaacattcttgcaggtgctggagatgttcatccttgtcctgcagcagtgccacaaggagaatgaggacaagtggaaacggctctctcggcaggtcgcagacatcatcctgcccatgttggccaagcagcaggtttgtcttcattgccctggtttgccattatgtagtgtgatttatttcagagtggactgagatgcttatgaaggttggttgtgatcattatatcctgacaggttcttgctctgaaagttggtcttggtgctggttgtgggaaaagtggcttcttttatttccattaccctttgaggttgaattgtcttctcactttccaagtgagggaacacagagtcagagaggttattgaggttttccatcctcacagagctggagggtgataggtctatagttgcttggcccagtgttgacttgaaaactaagtcctttcttattttattaccctgactcctgtattctggtaagtcaggtattttatttgatccttagctttcttttctttttttttttattggatattttctttatatacatttcaaatgctgtcccaaaagttccctataccctccctccgctctgctcccctacccacccactcccactcattggccctggcgttcccctgtactgaggcatataaagtttgcaagaccaagggacctctcttcccagtgatggccgattaggccgtcttctgctacatatgcagctagagacacaagctctgggggtactggttagttcatattgttgttccacctatagggttgcagaccccttcagctccttgggtgctttctctagcttctccattgggggccctgtgttccatcttatagatgactgtgagcctccacttctgtatttgccaggcactggcataacctcatacaagacagctatatcagggtcccttcagcaaagtcttgctggcatatgcaatagtgtctgcgtttggtggctgattatgggatggatccccgggtggggtattctctggatagtccatcctttcgtcttagctgcaaactttgtctttataactcctttcataagtattttgttccctagtctaaagaggaatgaagtatccacacattggtcatctctcttcttgattttcttgtgttttgcaaatcgtatcttgggtgtcctatgtttctgggttaatatccacttatcagtgattgattatcaaatgacttcctttgtgattgggttacctcactcaggatgatatcttccagatacatccatttgtccaggaatttcataaatccattgtttttaatagctgagtagtactccattgtgtaaatataccacattttctgtatccattcttctgttgagagacatctgggttctttccagcttctggctattataaataaggctgctatgaacatagtggagcaggtgttcttattaccagttggaacttcttctgggtatatgcccatgagaggtattgcgggatcctccgatagtactatgtccaattttctgaggaacctccagactggttgtacaagcttgtaatcccaccagcagtggaggagtgttcctctttctccacatcctcgccagcatctgctatcacctgcatttttgatcttagccattctgactggtgtgaggtggaatctcaggattgttttaatttgcatttccctgatgattaaggatgttgaacattttttcaggtgcttctcagccattcaggtttcctcaggtaagaattctttgtttagctctgaaccccatttttaatggggttatttgaatttctggagtccaccttcttgagctatttgtatatattggatattagtcccctatcagatttaagattggtaaaaattctttcccaatctgttggtggcctttttgtcttattgacagtatcttttgccttacagaagctttgtaattttatggggtcccatttgtcaatgctctatcttacagcacaagccattgctgttctgtttaggaatttttcccctctgcccatatcttcgaggcttttctctactttctcctctattaatttcagtgtctctggtcttatgtagaggtctttgattcacttagacttgagctttgtacaaggaaataagaatggatcaattctccgatgctcatggattggcaggatcaacattgtaaaaatggctatcttgccaaaagcaatctacagattcaatgcaatccccatcaaaattccaactcaattcttcaacgaattggaaagggcaatctgcaaattcatctggaataacaaaaaacctaggatagcaaaaactcttctcaaggataaaagaacctctggtggaatcaccatgcctgacctaaagctgtactacagagcaattgtgataaaaagctgcatggtactggtatagtgacagacaagtagaccaatggaatagaattgaagacccagaaatgtacccactcacctatggtcacttgatctttgacaagggagctaaaaccatccagtggaaaaagctggcacaactggtagttatcatgtagaagaatgcgaattgatccattcctatctccttgtactaaggtcaaatctaagttgattaaggaactccacataaaaccagagacactgaaacttatagaggagaaagtggggaaaagcctcgaagatatgggcacaggggaaaaattcctgaatagaacagcagtggcttgtgcagtaagatcgagaatcgacaaatggggccccataaaattgcaaagcttctgtaaggcaaaagacaccgtcaataagacaaaaaggccaccaacagattgggaaaggatctttacctatcctaaatcagatagggaactaatatccaatatatataaagaactcaagaaggtggactccagaaaatcaaataaccccattaaaaatggggctcagagctaaacaaagaattctcacctgaggaataccgaatggctgagaagcacctgaaaaaatgttcaacatctttaatcatcagggaaatgcaaattaaaacaatcctgagattccacctcacaccagtcaaaatggctaagatcaaaaattcaggtgacagcagatgctggcaaggatgtggagaaggaggaatactcctccattgttggtgggattgcaagcttgtacaaccactctggaagtcagtctggaggttcctcagaaaattggacatagtactactagaggatccagcaatacctctcctgggcatatatccagaagatgttccaaccggtaagaaggatacatgctctactatgttcatagcagccttatttatactagccagaagctggaaagaacccagatgcccctcaacagaggaatggatacagaaaatgtggtacatttacacaatggagtactactcagctattaaaaagaataaatttatgaaattcctaggcaaatggatggacctggagggcatcatcctgagtgaggtaactcaatcacaaaagaactcaaatgatatgtactcactgataagtggatattagcccagaaacttagaatacccaagatataagataaaatttgcaaaacacatgaagcttgggaagaacgaagaccaaggtgtggatactttgccccatcttggaattgggagcaaggcacctatagaaggagctacagagacagagtttggagctgagacaaaaggatggaccatctagaggctgccatacccggggatccatcccataatcagcctccaaacgctgacaccattgcatacactagcgagattttgctgaaaggaccctgatatagctgtctcttgtgagactatgccggagcctagcaaacactgaagtggatgctcacaatcagctattgggtggatcacagggcccccaatggaggagctggaggaagtacccagggagctggggagatctgcaaccctataggtggagcaacaatatgaactaaccagtgcaccaccaccaccaccaccaccaccaccaccaccaccaccaccaccaccacccccagagctcgtgtctctagctgcatatgtaagaagatggcctggccatcagtggaagagaggcccattggtcctgcagactttatatgcctcagtacaggggaacgccaaggccaagaagtgggtgtgggagggtgtgggggacttgtgggatagaattggaaataaaatacccaataataaaaaaaagtgtaaaaaaaaagaaaaaaaaagagtggatcaatttgcattcttctacatgataactgccagttgtgccagcaccatttcttgaaaatgctgtcttttttccactggatggttttagctcccttgtcaaagatcaagtgaccataggggtgaggattcatttctgggtcttcaattctattccattgatctacccatctgtcactgtaccagtgtactatgcagtttttatcacaattgctctgtagtacagcttaatgtcagacatggtgattccactagaggttcttttattgttgagaatagtttttgctgtcctaggctttttatttttccagatgaatttgcaaattgccctttctatctcagtgaagaattgagttggaattttgatggggattgcattgaatctgtagattgctttcggaaggttagccatttttactatattaatcctgccaatccatgagcatgggagatctttccatcttctgagatcttcaatttctttcttcagaggcttgaagttattatcatacagatctttcacttccttaggtagagtcactccaaggtattttatattatttgtgactattgtgaagggtgtttccctaatttctttctttttccgtttatcatttgtgtagaaaaaggccattgatttatttgagttaattttatatccagctacttcactgaagctgtttatcaggtttaggagttctctggtggaatttttggggtcagttatatatactatcatattatctgcaaatagtgatattttgacttcttcctttccaatttgtatccccttgatgtccttttgttgttgaattgctctggctagaacttcaagcactatattgaataggtagggagaaagtggacatccttatctagtccctgattttagtgggattgcttcaagtttctttccatttagtttgatgttggctactggtctgctgtagattgcttttattatgtttaggtatgggccttgaattcctgatctttccaaaacttttatcatgaatgggtgttagattttgtcaaaatctttttcagcatctaacgagatgatcatgtggtttttgtctttgagtttgtttatatagtggattacgctgatgggtttccatatattaaaccatccctgcatccctgggatgaagcctgcttggtcaggatggatgattgttttgatgtgttcttggattcggtttgcgaggattttattgagtatttttgcatcgatattcataagggaaattggtctgaagttctctttctttgttgagtctttgtgtggtttaggtatcagagtaattgtgacttcatagaatgaagaatagggtagagtactttctgtttctattttgtggcataatttgagattagttggaattaggtcttctttgaagatctgatagaactctgcactaaacccatctggtcctaggctttttttggttgggagactattgatgactgcttctatttctttaggggaaatgggaatgtttagattgttaatctgatcctgatttaactttggtatctggtatatgtctaggaagttgtccatttcatccaggttttctagttttgttgagtatagccttttgtagtaggatctgatgatgttttggatttccacaggttctgttgttatatctcctttttcatttttgattttattaattaggatactgtccctgtaccctctagttagtctggctaagggtttatctatcttgttgattttctcaaagaaccagctcctgatttggttgattctttgaatagttctttttgtttccacttggtagatttcagccctgagtttgattatttcctgccatctactcctcttggatgaatttgcttcctttagttctagagcttctgggtgtgctgtcaggctgctagtgtatgctctctctagttcctttttggaggcactcagggctatgagttttcctcttagatctgccttcattgtgtcccataagtttgggtatgttgtggcttcattttcattaaactctaaaaagtctctaatctatctctttatttcatccttgacaaggaatcattgaataaagtattgttcagtttctacgggaatgttgtatctgttgaggcctgttttgtgaccaattatatggtcagttttggaggaggtacgatgtggcactgagaagaaggtatatccttttgttttaggataaaatgttctgtagatattaattaaatccatttgtttcataacttctgttagtgtccatgtgtctctgtttagtttctgtttccaagatctgtccattggtgagagtggggtgttgaagtctcccactattattgtgtgaggtgcaatgtgtgctttgagctttgctaaagtttctttaatgaatgtggctgcccttgtagagttcctcttggtagattttacctttgttgagtatgaagtgcccctccttgtcttttttggtaactttggtttggaagtcaattttattcgatattagaatggctactccaacttgtttcttcggaccatttgcttggaaattgttttccagcctttcactctgaggtagtgtctgtctttttccctgaggtaggtttcctgtaagcaacacaatgttgggtcctgtttgtgtagccagtctgttagtctatgtctttttattaggggattgagtccattgatattaagagaaattaaagaaaagtaattgttgcttcctattatttttgttgttagagttgggattctgttcttgcggctgtcttcttttaggtttgctgaaggattactttcttgcttttcctagcgtatagtttccatccttgtattggtgttttccctttattatcctttgaagggctggattcatggaaagatattgtgtgaatttggttttatcatggaatactttggtttcgccatctatggtaattgagagtttggctgggtatagtagcttgggctggcatttgtgttctcttagggtctgcataacatctgtccaggatcttctggctttaatagtctctggtgagaagtatgttataattttaataggcctgcctttatatgttacttgaccctttttccttaatgcttttaatattctatctttatttagtgcatttgttgttctgattattatgtgtcgggaggaatttcttttctggtccagtctatttggagttctgtaggcttcttttatgttcatgggcatgtctttctttaggtttgggaagttttcttctataattttgttgaagatatttgctggccctttaagttgaaaatcttcattctcatctactcctattatccgtaggtttggtcttctcattgtgtcctggatttcctggatgttttgagttaggatctttttgcattttgcattttctttgattgttgtgcctatgttctctatggaatcttctgcacctgagattctctcttccatctcttgtattctgttgctgatgctcgcatatatggttccagatttctttcctagggtttctatctccagcgttgcctcactttgggttttctttattgtgtctacttccctttttatgtcttggatggttttattcaattccatcacctgtttggtcgtgttttcctgaaattctttaagggatttttgtgtttcctctttaaggtcttctacctgtttagcagtgttctcctgtatttctttaagtgagttattaaagtccttcttgatgtcctctatcagcatcatgagatatgattttaaacccgagtcttgcttatcgggtgtgttggggtatccaggactggctgaggtgggagtgctgggttccgatgatggtaagtggccttggtttctgttagtaagattcttatgtttgccttttgccatctggtaatctctagagttagttgttatagttgtctctggttggagcttgttcctcttgtgattctattagcctctatcagcagacctgggagtctagctctctcctgagtctcagtggtcagagtactctctgtaggcaagctcttctcttgcagggaaggtgcaccaatatctggcgtttggacttgcctcctggctgaagatgaaggcccgatagagggcctgtctcagaagctgtgtagcttctgtagtccacactctcacctgcgcagactagtctctgagggaaccaggacgaaagatggcttccccaggtgctccagcagagcccttccaggcggggtggatacctctcctctgtcggggaaggtgcccagatgtctggatcccgaaatggggtctgtcccagaagctgtgtcgatccttagctttctttatgtttatttgttttttcatagcacttacaaagtaacctagcaataatttatgacttagtcagaatttctgtaatcagatgacccttactagttaattaagaaaatgcagtagtccggctgtgccatatcttgtggaaacaaagagccctggctcctggactgtgtggtcctcagaacacaggaacctgtgtgactctcaccaaagcaccattacaacagaagatagaacacagagcctgtctatacacagtcctaccaggaagtctgagcagctgccagatggatctctggctatgctttgaatgaaactcctaacagatgacaaggcactactttgaaataggttctgtagaaagcacaagggagccatgtttctcggcatctcataaactcttttaggcatactctattggtagttgctgtctgcatatgctaggcagaattgcaggcactgataggaaaaatttcactgaagaaaatgtattgaaaagcagtgttctcccacctagataacaatgaaataaatacactattaaagtatatacaatatcagaggatagtagttttgatggcagaggaggagggtagtgtagggtagagaatgcatttgttgttctaacagtgacaaaatgagaaagccttttttaggaggtgacattgagtaaacatgattctagcagttacctgcaagagagtgtttcagcagagcagagagaaaagcaagtccctgggattgcagcatgacatttggatacaagctagtcccaggaaaaggaaggatgggagggtagacatagagaaatagtgtcctgaaactttgctaaggttactgctgagagtaaaatgcagtggatacactgctgaaagtaaaatgcttttaacttttaactgcgaggatgatggtgattgtgtgccccagaggcgcagtgatgacgtgtgtgaagctgctattcccatcgtattacagacatatccatgatgcttaattccacagatgcatattgactctcatgaagcccttggagtgttaaataccttgtttgagattttggctccttcctccctacgtcctgtggacatgcttttgcggagtatgttcatcactccaagcacaatggtgagtgtcaccatatgtttgggatgcactggaggaagatcccagcccaggtctgccacagctggtgagggaggacttgagggtttgcgttttaccaaatctccaaccgagtctgatctgcttctctgggaccatacttggaaccagtgctctagggacttttctgttgaatgattttcttccatgggattgacaagcagggaaaatttaatctttccttagctttagcatatgcattttctttttctttttcttttcttttcttttttctttttaggcatctgtaagcactgtgcagctgtggatatctggaatcctcgccattctgagggttctcatttcccagtcaaccgaggacattgttctttgtcgtattcaggagctctccttctctccacacttgctctcctgtccagtgattaacaggttaaggggtggaggcggtaatgtaacactaggagaatgcagcgaagggaaacaaaagagtttgccagaagatacattctcaaggtatgttttctgtctgaacctgtaaactgaccatgtcttttagctgatcctatggtgtcgcagcagcagtagccaacaataatcactgttctttagtgaggctgatatcactcacctagcttttttttttttaagaaaaaaatgaaaagatttgtttctttttattgattgtgtatgagtgttttgcctatgagtaagtaagtatacttagggtgtgtctcatacccatggaggccaaaagaaggcattgaatctctggaattgcagtttcagacagttgaagtgtcattctctgaacccaggttctctgccagatcagcaagttcttttgaaccctgatttttcttcttaccttcctcaccttttttttcatgtctttcctaaggtctgtccttgtgacagacttgacaagagtggctcaccatgattaaggaggggtggccttccctgcatgcagcccagtaaggggtgaattgcctgtagcatggtcaaagcctagggtaagccactgagaagcagccctgtacttattttcaccatgtgctacttgaaggacctttcgttgccaaggtcaatagcatctaccagatacctgcaggatcagctcacatgctacacacacacacacacacacacacacccggtgtgctagtgcctcaagggcagtgacaggggagactgcttatcaacgctctgcacagagaagtatctgtgactcctagagttttcactaagttagagctgtgctgcagatgtgctccttaggacctctcatttgcaggggtaagcacctgtagtctctgataaacacacgatgcctttgtgtttgcaggttcaactggcagcccattgctttccctccgttaggttgaaggagtggctaaaactgatgttacactaagtttctttttttatttcttttttttttaattgagtatttatttcatttacatttccaatgctatcccaaaagtcccatacacactcccccaccctcccactcccacttcttggccctggcgttcccctgtactgaggcatataaagtttgcacgaccaatgggcctctctttccactgatggccgactaggccatcttctgattcatatgcagcgagagacacgagctccggtggggtggggggtattggtttgttcatattgttgttccacctataggattgcagatcccttcagctccttgggtactttctctcgctcctccattggggccctgtattccatccgatagctgactgtgagcatccacttctgtgtttgccaggccctggaatagtctcacaagagacagccatatctgggtcctttcagcaaaatcttgctagtgtaagcaatggtgtcagcgtttggaagcttacactaagtttctatggcgaattaccgtcttatatttatgtaacactcctacagctgataaagcttaaaaaaatacattgtcaatttgccttgatgggcctttgaaagtggtatgattaccatttcacatttaaagaaggtaatagagagaaggagagactcagtccacagtgatggtctgaaacatttcacttggtttagtgtactgtctttgtgttttcttactttacaaaaaccaatggtctttatttcacactgtgcttagcacagctcactgatcatggcctaatctgctgttatgtgctccctttcttggaaggtttcttttacagctggttggtattcttctagaagacatcgttacaaaacagctcaaagtggacatgagtgaacagcagcatacgttctactgccaagagctaggcacactgctcatgtgtctgatccacatattcaaatctggtaagtggatccgattagacttcataatactttgtgttccctgtctccagcagtgcccgcttctcatagaaactgttctccatgttccttgtgccatgtgagaaaatgttgatagtaggagtgaatctgataccatgtggtccagcaattacattgataggcagatacctgacaggatgaggagcagagtgcttggaagatagctgtatactaatcttgatagtagcattcattacatagctgaaagaagcaactctgacatccaatgctcagctggttgataagccaaatatggcatatacataagttatagagtcaaatgtgtctatgtgggatatttttcagcctgaaaaggtaaaatagttctgacataagaaacaacatggggtgttggagacatagctcctcagttaagagtatttgctgttcttgcagaagaccctccttcacttcccagtgaagaggctcaccattactgtaactccagttccagggatctgatgcggtcttttagactctaccagcaccagacatacacaagctgcatatccatacatgcaggcaaaacactcatatacataacatttaaaagccaacataggtgacccttgaagacattgtgctaagcaaaataagccaggcccaaaaagacgatggatgagatactcagagtactccaaatctagagacaaaaaacaaaatggtagttgccagtggcttaggagaggatttaatgactttggattttcagttttacagatgatggtgatattgtataacataagtgcatttaataccagaactgtatatttaaagattatcaaggtggtaaattttattttatatgtattttaccacaataaaaaataattggaggcccataggccttagtagatagatgtttgtaagcaaccctgacaacctaagtatgatctctaagacaaacatggcagaaggagagaatgaactgcttccaagttattctctgcctccaggtacgtgcaccccaccaccaccagtaaacaaataaacctaaagagtcatgctgggaatgcagtgaatccattggtagtgattgccagacacgtacaaaaccctggttttgatctctacctaacctaaacgtgatggcaccccagagaatcagaagttcaaactcatcttcagctgcatagagagtttgaggcaggacgatctacatgaagacctgtcttagaacagaatattttttaaacttgtttgtttaattggtggggtgtaggtgggagtgtgatatggtggcttcatcctgtagtcttcgtagcatatttccacattccagctttagtttctatcatggccttgctctttgggggactcatttcatgtggcagaagtagggcctctagccaccgtggtctgagcctctgaagtatgctgattagcctccattcacccatgtaggccatatgagctcctagctgctccgaccaacttgagcagccttcttttgaagggggtgtgttgcctcctgggcagaaaggaaaagaaacagatgatgagcggatagtttgggccagagaaactgttagaacactggaggcaacttctagaaacccagccagaagtgccaggaaatggacgatgtggcagagtgtttctccagtcagaaggtgtgctctgtatttggagttctatgtgcattttatgtacatatcttggagaaaaaagtagttattgtccttagccttcatccaacaggacttatattcttacctgttgctatactgggctctgacgtactgggttgagacaagcagatgtgctttttgtgcccttgtagagcttcacagtcagtggggagggtagtacagcaatacacaaccactgtcccaggaagttcattggtacacatttctgagggtgcctggtttatctggtttacccaaagaggtcagcagaatcaacctttggagttggaagaacaaactagagaaatggagttgagaagagagtagagagtaaagcaagctgctcaggtgaacagagagaaaggcattatgtagactgcctcccttgtatctggcacccttggcatagtagtgtgccagaatttaattttgataatgggtgttagtttcaaactatatttattcctaatattgatttaggtattgttttttgtctaaagatttatatacttgtttgttgtgtgtgcaggagagagacaggcaggtcatgtgcatgccaggatgggcaactcctcaggaatctcttctctctttccaccttgttttgaggccgcttcttctgtttctgtgattgcactgccaaaaagagcttttcaccaatcctcctgtctctgccttccatcttgccgtacaaattaaatgcccacccccacatctgacattttccatgggttttggggattaagcttgtacagtaagtgtttttactaactgagccaactgtctggcccttaaagatcttttgatttatgcttcattggtcactgtagcaaattgaaagtcaagaagtatgcctgtttatgaatagcaagttgtttttagtttgttggtcactttaatattttccattggttggtttggatctgataccagaagagctttctcttgccttctttggatggtagatgtctatgttgtgtcctgctcacctggtgggctgccatgtgtggctgctatatggtttcactacttactatccagttgctctagcttctcttgcttcctttttcaggaacatcaaagaggaaaaagattcaagggcatatttttactgtgtgttgtgtcagtgttgtccagcaaagtgacctttagctgcccagtgactgggtagctaatgcagatagcatatcttaggtactttgtgactttgtttaacttcagacacaatggcttaaatggcttcatgtggtcagtggttccacttttttttttttcatcatgcatacatccttctggaagaacattcaatggttagacatacaggctttgccctagtgctgatagattatatataaatgtctatttcttatttagtatgacactaggtgtcagaactactgtttgggtatttgcttggtcttaagattgggttgaagtaaacagctatgtgtttataaagatatatatttaggtctcttgacagttatcctgtttgcttgggtagccccttgtgcttccgtctgctggctgtggctcagttctgtgttctcccaggtgtggcctgaatcctttcccctgtgttggctggctctttctggccacctgtgtctaggcctccacagcagctgttttggggctcctaaagaatgtggcaattgagcctggcagtggtggcgcacaccttcaatcctagtacttgggaggcagagacagggggatttctgagttggaggccagcctggtctacagagtgagttccaggacagccagggctacacagagaaaccctgtctctataccctgtctcgaaaaaacaaaacaaaaagaatgtgtcaatcatcagaggtgcaaaagtggactgacttgttaagtaagttgtgcctgtttctgcttagaaaagttagagtttggggctggggaaaaccctaatcagagaagtgcttgcagtgcaaagtgtgagagctgagtttggattgccagcaccttattccaagcgttccttggcagccagtatatctaatcagtgagctccagctccaggttcagtgtaggagaccttgtgtcaaaaaatcagatagagaagtaatattgaccctacatcagcttttaacttcagcacatatgtacccaggtacacacatgcatcctcacgtacatagaagcacaagtatgcacacacaaaggccacaattttctaagtgccaagtgctataaaagtatggaaaaggacaatgaatagtccttggtcacctggtactggaccaggtagaacagtagaggcataccccataatctgtttttcttatttttgtttggttctaggaatgttccggagaatcacagcagctgccactagactcttcaccagtgatggctgtgaaggcagcttctatactctagagagcctgaatgcacgggtccgatccatggtgcccacgcacccagccctggtactgctctggtgtcagatcctacttctcatcaaccacactgaccaccggtggtgggcagaggtgcagcagacacccaagtaggtgcacagctccccagggccaggccccagcccagtgtttggcctgaggcaaagctgctctgagagcattctcattttccattctttataaagctttgtaaaattcaggctgcatattaatctttctttcatgggtactgttttgtagggaaatgtggtctggctacaggcattcagaccaaactgtttgactgtgattttctttgacaagcgctttgacactgttccatcgtttgggctatgcttgtcaggctctatccctcctgccacgtcctacggctctcattggttctacagccagacatgttgcaatgtcttaactttgttatgagtaaatgtgttctgggtattcttagataatgaagtaattatttagcaaatttcgaaactgattggaagtattttattaatttatttttactattcagatagactgtttctggttgtgggtggccctctttttttttgcaaagagtttgtagtcttaaatctcagtgcccaggtactaactgactgacttgctcagtcagctctatgagcatgtttgggagctagaagctgtgagccccgatgagtcggtcttcagtgtgctttctggacagtttatgaacacttgtggggaaatttttcctaaggaaaagtataggtattgttagctcttcagcttggtgtagggagaccagagcctcccatccagacatgcttttacatccctgtgtccggcattttttgcccatctgctgtgtgctctttataatgtcatctgcaaaggaaatagaaacactacttcctgcccccacgtgtgatcacttggagaggtacccacaacatcatttgaaatgcttagaggatctcttaagcctgtcacattaactgatcattataagagctaggacaggaagccagctacatagctctctggttcttacatgtacatgtaaatcagccctgaaactgcttaaagcatttcagtccaggaagcttcgtaggggctaggagtttgcacatattctaagcccctgctgctgccagtgcggttgttgcactgatgctctagcacagggacagctcagcaccaccagtgttccttcctttcttctctttctttcttttctattttttcagtttttttaaaatttttataaaaatgtttttatttgaaatagaatcacatcatttccccccttccaactaccctccaaagcctcctctatacctctcttctcacattgatagccttttctccaatttgttacataaacatgtaaatggtatgtgtgtgtatgtacagtatatataagttcaatttactgtgtctgattttgttatttgtgtttatatggattcattgttggctactctacattagacagccagtaagcaggctcatccctggaagaggctaattctcctttcaaaaagttattagctacttatattttttgtctagggataagatctatgaaaacttcccccatccatattaatatacccatgaacactgcctttattgtagtcttatttgtgtatccatttctctcctagaccgcttcacagcagactttctggtattctggcccttacaatctttctgctcctctttcataatgttccctgagccacagatgcaggaactgtgatgtagatgtatccactgggctagactcccctacagtccatggatctctagttttgtccagttgtggttttctatgattgtcttcatttgctataaagagaagtttctttgataagggtggtagctacaaattgaagctcagagctgtgtataatgaagtctatctttaatctcagccttcaggaggcagaagcaggtggacctcagtcaattcaaagccagcctgatctacaaaccaagttccaggcctgccagtgctacacagagtaaacttgtctcaagtaaataaacaaaaacctggcagctttgaccttagtaaggagactcagtgcataaaggaacttcctgctaagcctgagacttgagttctaaccctaagacccgtatggtaaaaagggaatctgttcccatatgttgtcctctgatatccacaggcacatgggtgcacaggcacacaaatcatttgtttaaaggcttaaaaaacaaaaataattggggcctgagaacttgcagtaggttcccaggacagtctagtaaacatccaagcctgagttgtgttgggtaagacacgggagcctccattaactatggatgagccaagaaggcaggagaaggtaagaatggctttagcccacagtaagccataattctcagcaacatctgcccacccggttggtgtataatagtgttgaagattaaaagacatactatggtttgttcaagaggaaaatggattttgaccttagctgatggatcttttaccaagatgtctactggacacgctgaaacatctgtggtaaaagatgaaagtgttatgttaatagaagaaaacaagtaggacaagtgaatttattttagaatccttggctgtgctctggatctggaatataagactgctagaatgattattattgggtagtcataaatataaggatgagttttctgtgagtgatggctttgtagctgtgaacatgtttgggagacaactgctgcagagtttatagtgaagtgtgctctggaatcattcatccgtgttgcagccaaagaaatgcatgtgtgcaagtattcagactgcaataacgtttcacatgagtgtgcagtgtgtgtagagtccaagtaggatatttggtatgaacctagtctgcatgtgtaaagtgtgttcatgaattcaaacatgaccaatattaatagttgaatataggcaaaaatcaagggctgttcattgaattgttccttcaagcttttctgtttgacactttcaataaaccggggaagaaggtggaaaagatagcaatcagagtcagctcttaggccttactataaggggattggaactatgagaattgggatcatagtttcttttcatttatatttgtgtgtgtctctctctgtctctctgtctgttttgtctgtctgtgtctgtgttaatgtgcctgagcccacatgtagaggtcagaggacaactttgaggagtgactcagtcttcttcttccactgtggaatccagggattgaactcaggttgccaggcttgtgcagcaagtgcttttacttgttgagccatcttgccagttcaagaggggatttctagtgatagaaataatagtaacatttatccaaagggctacagattggagtgtacagaagaagcttccttgagttggtgaatgtgggatttggacacaaacattggttttattgtagtagttattggtagtttttcaaagttgaaattacagtttctttctttccttccttctttattatgtgtgttggtattttgtctgtatgagggtgagatcacctggaactggagtgatagatagtagtaggccaccatgtgggtgcttggaattgaatccactggctggaagaatagccagtgctcttcaatactaagccatctctctagctccaaaattaccacgtctcaccatacacaatatattaaaatgagaaacctatctatcactttcagtttttagtgcagtattcttcagagaagccgcccatgcttttcctcatttgcttagatctcaaggtctgcacttaggtaacttctgctcctcagtagcaaggtcataattgagcattatttgtgtgatgatttgattagtagctgtctcttctttctatggttgctgttatattccagtcagtaccatttcacattcaaaccataacaatgtctcctgctaattatttaattgcaaatttcacctattgtacgtgagtagttcttcgctgtacatgtggctatgagtgtaagctacaaagctccagctgtgaaagggcaggggttctgtatatgtttcctaactgacagagggtgcctggtgaaatgccttttgtaccatctgttgtcagatacaaacagtaccatcattccaggaagttccctcttgtccctttatcaccatcccttcccttgtccataagaacctccgtgaatactctgtgcccagagcagaaatccatggaaatgaacactgcatccggttgttgatcagcaaccattgatcagtttaaagtttatttccctggtggtgatctgtggtctgctcctgcattactgagttgatcccactacagatacactaggttattcatccatctgctacctaggaagcagaaatggttggcagctttaacaaacctttagcttgcagcacaagttttatcgataatctattagtactgaggacttacaggactggtcaacaaatttcaagtgtgctttctctcctgtgacttctgtccctattgagactgagcaaaagactagaaatatgtcagacatggtcttttaaatatttggctataactgaaagtctccagggttatatttagaaagatgcaatgagaaaggagtatgagtggagtaaccactgcagtagagaagaagcactttgaacagtaattccacaaccatgactttctcagtaatgtttttgaaaattagtaggaaagtgtgaaatgaggcttctccctggcacttgaaggtgtttgtagaacatgagaaatatcagaacaactgctccattatcaaacatggccagtgtgaattctggaatggacatgctatttggaattgcagccttaaatagtgggttttgcccttcagtcaagcactgtaatcatctggctgctaaactctctgtgtccttcaatgatttctagggacagaagtctgaggtgcataaacacacaccaccagtctgatagagcaatatctggaataacttgtgggtttgagaaggaaaatccatcatagctttgttcaatattgtgtgtctaagtttgtggctatcccagacattccctcattgcatattcatgccttgtaggagacacagtctgtcctgcacgaagtcacttaacccccagaagtctggcgaagaggaggattctggctcggcagctcagctgggaatgtgcaatagagaaatagtgcgaagaggggcccttattctcttctgtgattatgtcgtaagtgcccacaagagctcttatggtagagggtggcatagatgctgcttatatgcacctgctaggcaaccaaattattcactgtgccacagatatatcaaagctgaggagaggtagcaatgtttactctggagtttaattagagcagtctggtgacatttttccttgtattgggcagctgtgttttttgattcaagaactctatcaaatctgtggcatttagagtctgttttctttactaagcattgcagacagagtaagtagaacagcccatgctaggctggcctgcaacctggtagcaagttgtattcctacatggggcttcctttgttcccatgcatgcaaactccaggccagtcgctagggagggctacaccagagtgctcaccgtgctcctgtgggcatctacctcttgacttgtccaaggagccaattctctgatattgaggcatttgctggtgtctctaggagctggatgttgcccttggttcttggcttcctgtggcctctaccacatgtgatcagaggtgtaaggttctataagtttccttcctttctctcatttacttatactcagacacttgtcttcaccaaggcaaaatttgtatttcaagtgtgttttttcttacactttgtagccttcttgtccacttgaaatatatcttttattatatctttctagtgtcagaatctccatgactcagaacacttaacatggctcattgtgaatcacattcaagatctgatcagcttgtctcatgagcctccagtacaagactttattagtgccattcatcgtaattctgcagctagtggtctttttatccaggcaattcagtctcgctgtgaaaatctttcaacggtaagtctttagcctgccagtttgctttctccaacttaaaaatgggatactgggattttgtcagtactagttatcagtctgaggaataataaatttcgttccttctcaacattagccaaccactctgaagaaaacacttcagtgcttggaaggcatccatctcagccagtctggtgctgtgctcacactatatgtggacaggctcctgggcacccccttccgtgcgctggctcgcatggtcgacaccctggcctgtcgccgggtagaaatgcttttggctgcaaatttacaggtactgaaaatggtaatttatatcaaaacttagaaagtcaatcaaaacatttggtctattgacctggtcttgattggccactgataaagagcatgtatgtcatatttgttatttgtgtatctgaccaacggctctttttagatatactgtgtatagtaatttatcctttttaagtgggtgtgaggttgtatatcacaaaagccctgatgtgttcttgtctgtgtagagcagcatggcccagttgccagaggaggaactaaacagaatccaagaacacctccagaacagtgggcttgcacaaaggtaagactgcagcgtggggtcctggcacttgggcaaccagcgtattaacacatagatatgttcaggaacaaataggtagacaaaggaattagtgtacagtgagtttactacagcaatgccagagtagaaaagactatctaaatatcagatgaaatttagtcatgtctcactttagtagacatgaagaagtggcactcaaatacctgttgcacagagaagggactcctgaactttgtgactgttgaagggataagaagtatgtttgttacctctgctactggaccctgactgagtgggaataaagctagaacctaattgccaggttggagggagtaaacatgagagcactacctggctcttggcatgtgcacattatgttaagtgacatctcttcatagctattcttttgcctaattgtttgaaagtcttttagaagcctttattagaaacatttccatctgtagtgtaagtgtagttccttgactacaagataaattaagaaaagctttcacctcttttccattgctgaagggggaagggagcattcgagagggtctctcataactttaatcttcagaggatttttcatggtgtttcataatgggacagggcatggtctggatgatttttctcaatctgcagagccacatgatgctgacatttgatcatttgacatatgaagtatcacattgactctgtatagtaagagaataaattatcattgtgtttgacagtagttgtagtcatagaccaagataaggaagattatgacttcataaataatttaggccagatgaaatggttttctgtgaaatgaccatttctaatggaatgaattgtgtcattattggggattaaatggagtttgtgcacttggatcttaaaatttatctgttttgcacacattacaaatacgatggctaggattatgtaattcagtggtaaagcacttgtctagtgtgcacaagtccctaggttcaatctctaatattgccaagaaaagaaagagtagaatagaatagctttgttagcggttatatagttcattgcctaatggaatgttgagcataaatgaaacttctggaaaatatcagtgaggtataaattttggtaatttaaagtaactagggcgtaaatgtgcatcatgactttagaatgttgaagggaaagtccaaaacctgttgccctgtcttaagaagctcctagtgctccttggtattacatgtttctagaactcatctgtgcaaaaactgagatttcaaaccaaagaacaaactactctggcttttttattccagacaccaaaggctctattcactgctggacagattccgactctctactgtgcaggactcacttagccccttgcccccagtcacttcccacccactggatggggatgggcacacatctctggaaacagtgagtccagacaaagtaagtgtcccgaatgtctaagtgtgatgaccaggaaccctgtggagacaatgacagcctctgtctacaatgaggatagtggtggctgtcagtatacatgggacctgacactcagctcaggtcattagatgccctgcttgggattagagtgcaggatggaggccaagaggtcctactgagaacaggagtgctgatgtgaggcttttgtggaggactgtgggggcaagtcaggtggctagtcagcaagtcaggaaaagttggttgtggtccaggacctatgactgcagacattgtccagcacatgctgacaaaacttggcctgcctccccctctgaaccttctatctcctataaattgatgcacctactgccaccagctatataatgtattgtcatctgtaccctttctcattcacacttgagaattagaaactgttagggcctttgccttttaggcaaggagatgagattttagaagcctgcagcccatgacagaaaacacacatttgccccaggctcactctccagctttgtgggaggcatttctttggctttggctgctgggaaagatgagggaggcagatactccagtatagtatagatggtgcatcatctagagtgcaggtagagcaaaaattgtgaacactgagaacttggctgagtttgcaaggactgctggaaggtccacaggtggaaaagaagagggcattcaagcacagaacaagagagggaagactagctgtctagagagtgtaagcccaagatgtgtctgatgtctgtacagccagccgtcggtgcttctatcacagcccagagaagccgaagtgcctacccagtcccattcaattttcttttcttctcaggactggtacctccagcttgtcagatcccagtgttggaccagatcagattctgcactgctggaaggtgcagagctggtcaaccgtatccctgctgaagatatgaatgacttcatgatgagctcggtaggcaataatccgttgagtccaggaaatcctcagctctgcttgtcagaaagttagatttgtgtcttagttagggtttctgttgctatgatataacactatgaccaaaaagcaagttggggaagaaagagcttatttggcttaacaccatcattgaagaaagtcaggataggaacttaacagggccagaacctggagtcaggagctgatgcagaggccatagaggagtactgcttacttgcttgttctccatagttggtcagcctactttcttacagaacccacgaccaccaacccagggatgacaccactcactatgggctgggtcctctgccatctaccactaattaagaaaacacccacaggcttttgatgacattttttttcttgtttgtttgttttgagacagggtttctctgtgtagccctggttgtcctggaactcactttgtagatcaggctggcctcaaactcagaaatccacctgtctctggctcccaagtgctgggattaaaggagtgcaccaccaccccctggcttggtggcattttcttatctgaggtttccgcctcttagatgactttagcttgtgccaagttgataaaactagccagcacaatttgtctcatctttgtgtgattaatatatgggaaacctgagttcaagcaagggacaccatcaagcaaagcacatgggaggctctaacaaaaaatggcacacgagagctataatccagaatagctagcacatgagatgtgaataggatgccgttttaaacaaactagaatcctaaaagaagaaaattgttttaacttgatctttcatacctttaaagaaaacgggtggtcataggctatggtcagttgatcattcatttcctgactataagaaagtattgtgtgttcattgtcttctggaaattgatctctagtaacccctgtattaattactttctcgttgctgtgataagacactgaggaaaagcagttgagatgaggagggtttgttttggcttacagttcaagggtacaatccttggcaggggaagcatcacggtaagcttgatgtgtctggtcacattgtgcccgtgaccagaaagcagagagaagtgactgctagtgctgagtttgctctgccctttgtgttcagtccaggatccctgcccacagttaaagtgggtcttcctacctcaacctcatcaagataggcacaccaagaggttattatctcctcagcagttgtagaactgctacgctgacatcagtattaaccattacacccatcatgtagtgaggcaccttgtccctgtagataaagaggcattctgtcatgtagtgaggtaccccgtcctctctagatatagaggaattacctcatgtagtcagatgccctgtactgtctagatacagagcaattctcctccacttacccctcgaataccagaaagcatactgagagctggtgcaggccttgaaagcattcaattcccttccttgtcttctttgccaagcactcttaggccactaccttagtggggttctttgttgcccagtgaagacaaggacctcattgccccttgatacatgccaaatggttatggggaagcaggaactgagcaggttaatagaaggtgtgtgtgttgtggagagagagggttctcacataggaagatatctaaagcacaggacccagtttgttatattttccaagtcgttaggtggactattagcagcttgcaagttccatccatgaccatagaaatgtttgatttgggggaactaatgatgaaatacagtgtttaatattaaagcttatgttctacttgaaaaaattgtgactctctctaaatccttaaatggcttaaaataagtttttgacaaaacataataaaaactgtcatatgaggccagacatggtagtgcatatctttaattccaatacttgggagtcagacacttgaggatctctgtttgtgacatgtctggttgacttaagttccaggccagccagggctacatagtaagactatctccaaatcaaaaaaaaaaaaagaaaattaaaagtttttggcatgtgaaatgttgtgtgtgtgtttttttaagcagatttttgtctaatataagatgctctgtgtgccttctcaggctgcagcattgcttggcatcccactggattcttagatggcatattaaacttggtgcgctgtctacatcaattaagatttgtcatcctagaattatttcaatgaaatataagatcataaaaattaaaaatattgctctttctctctttccctcccccctctctccacgtggccatggccagtctctctctctttctaccttctctcctttctccctgactttctacaataaagctctaaaaccattttaaaaaattaaaaatattactttaaaattcaaatatgacagtgaccagaaatatttattaagcatgttaagtggagttgttgatatatttattaatatatataacataggatatactttttaaaatagagaattcaacttagttttatctgtcttttaactttatttgtagtctaagatcttttctagagagtatttcccacttttattattataagttacttgagacaagctacatcataagagaaaaagatttattttgactgatagttctgcacatacaacatccaagggctcatctggtgatgactttactgtcagagtcccagtgtggtgcagaaaacctcccatggcaaacaataaggagcttgagtgtctctgtttctagaatattctcagaagcattccttacagttctttggtctggattatctcagaaacaaatgcttattgcattaactgtgtgtgttccagcctgaaggaaagcttactgtctttgctgttgtttgtcttgcatgtaaacttctgacccaggagttcaacctaagccttttggctccctgtttaagccttggcatgagcgagattgctaatggccaaaagagtcccctctttgaagcagcccgtggggtgattctgaaccgggtgaccagtgttgttcagcagcttcctgctgtccatcaagtcttccagcccttcctgcctatagagcccacggcctactggaacaagttgaatgatctgcttggtaattaaatacagttcccttggatgcttgtctgtctatcttctctgtcactctgtctctctttatgggtgataggaatggcagtagcagaatggacaagccagagggacactgagtcacacattgaacctagagctgccaactctggtagatcagctgaccaagcctctaggaccctcctgtctcagccctaagtgctgaggttacaggtgtacacccacagccaggttttacataagatcttaaattccaaactcaagtcctcatgcttgcacaggaagcacttatccaccgactcatcctctcagctcaagttatcttagtgttttagttattttatattatgttatagttgtctgcatgtatgtcttcaccagatgcatacagtgcccatggagacagaagatggcatcaaatcccatgggactggaattacaggtggctgtgaacacactatgtggcagctagagatttaacttaggtcctctggaagtgcagctcatgctctcagctcccgagctgtctatctagctacaagttgtcaccgtttttaaaagtattacagattcagcaccgtgcttttcctcaagcacgcatatagtcaggactgttgatctaaaaggctgacaaaaatagctgagaaactgcaccaaatccttagctctaaacttctttctttgttgcttgacctggacatagaaagtcaggttctaagcccttcaggatcagtgggttagactcagggcaaaccatgtcctgactttatgtagcacgtatgagtgagcatgtacagatgtgcttgctctcttggtcttggcaacctcaaattcacatagttgtgtgaaggcttctgaaggggcgggcctgtgctcacagtcaaagtcactcatgtcagtctcatgtttcaggtgataccacatcataccagtctctgaccatacttgcccgtgccctggcacagtacctggtggtgctctccaaagtgcctgctcatttgcaccttcctcctgagaaggagggggacacggtgaagtttgtggtaatgacagttgaggtaagagcagctctgaaattatgtgtccctgtgaggacaggatatgtgagtagcactaagatgaaagtccttgaaaaccgacagtgtggagtacaatagtgcacacattagcccagctgccttggaggcagaggcagaattgtgggttcctggtctgtaaggatgtgcctgagtatacagctagaccctatttgaataaacaggaaggcagggaatacctattggcaaagtctgattcacctgatggtacagagtgcctttcaccctcaccactgggaagcaaggaggtctgtaagacatcctgttatccctacactataaacctaatgtgggtcctaaataaaatctagacagtgttacattttaaattgggcagtgaagctggacatttcacccagaaacacttggcccctcaaaatgtatctatacgtgcactatagttttattaccttgccatgggcatgctgggaaagagcctcactgtgccagagctgtgctgccaatcctgaacaagggttgacaccttaccctaagagaagaaagtcagtatcctgagggtgtatggtacaaaggcaccaggtgaaccaggctaagttaggtggtctttgagcttgtcttagcccagtgaagacaggaaagcaaatgtgtgtgtaaagtattgggtggcagctcctagtcatactctgcgctgcacaggccatgccatgacacttgtttcctataaaaactctgtccccatttcacacatggggaaagaagctcagagaggttcggggacttgctagaagtcactagtcataaatcatactccaaaactcagtgttgtgactgagatacaaaacaaaacacattctgtttctttaaaaaaaaaaaaaaaagtccaatgttacaggagccctcaagaccctggctggaggctttgtatatggctcagatcaagtttctatgggcacccatggttctaaaggaaaaagacacctagggtaaggttgggcattctggcagagggaaggctggaacttggggtataggtggatcaggactgaatattaagaaaactaggaatgacaacctagaaatgtgggtcaggggccattcttctgcaaggaggttgtctgatctcctgccctctccatctatccatggtcttccatatcttttattggcactgcttccctagaggtccctgagatagagtcctgggtgagcattctaacacagtgcttccctttaggccctgtcatggcatttgatccatgagcagatcccactgagtctggacctccaagccgggctagactgctgctgcctggcactacaggtgcctggcctctggggggtgctgtcctccccagagtacgtgactcatgcctgctccctcatccattgtgtgcgattcatcctggaagccagtaagtttttgtctatgaatgattttcttgtcttcacacagctcaactgataatcagcaatacatgtcaggctggaatattttttcttcctgtcttgtatttcccaagaaccaagttaggacttggggtggaatggatagattgtaggtgctgccttcagaaggcccatttgtccacccccagaccttgtcattacactagaacttaacttgaatttgcttttctagctattttgttttagagtttggagttctagctcttaaaaaatattttttaagttttatccctttgatctttagtcttagttgactatttgatgttcttagtcctagatgattataagattaataagattacattcaatagatgacttctgttagagttgaagtgtgtgcttgcatactgcattgtaatgctaatatgttgtaaaataaaagggattcattcttttcaaggaacagtgtcctcaacaagggtcattagctaaaaatttttaaaaattggacattatagtttacatgttagaggatgttttgaagttttatgttttcaaattaaacattatagagtggtgttttgatctttcattgtttaaattgttttcatctgtgcattgtagtcaacttggaaacaaagatccagggattaattttaaaaagctaggcttcttagtcaaagtgacgcttttagcagtattgagttgtgaatagtctgataaaaactctcagggtggagatggcagacggtgcatttagaagcctcagtgcggaagcacaagtctttgtctgttcatgactagccaaagcactggtgcctgcatctgctgttctccagtgcttttcagttttacagaaactgcttctagaaatctagccctcagttgacctgtcatcgtacgtttctatgaggctgtacaggcatgaagtaccttaagtacaaagaagagttaaagtttatgttctgctgtaatttcagttgcagtacaacctggagaccagcttctcggtcctgaaagcaggtcacatactccaagagctgtcagaaaggaggaagtagactcagatatacaaagtaagtcttaggaccattttttccccttctgtgtttctctggagccttccaattcattggcaaaagaaactcacgaagtggactctgggaaacattgctcttgctgtcctgagggctcatctagactttaaggggcaagagggctttttgaccatggctgcatatatgttcctggttttgtaagccctgtttttctagtgaagattcccctttccttaatcagctggtctgactcatcctgcatccttcctcacaacctggatttgtacctcttccctgagaagcactgcctcacccccctgtcttagcctcagcacttaggctactttaggataaatatcttttccttgtctgtgctctcaaggttgctgcttggtttgctgtaagtgactggcaaatatgtattaaattctgaatgagtaactcaaaattttaaggaatttgaagttagtgcagatgctatatgatatacggtaaccttagtgactatttcagacatctctttagtgacatttgttgacatgtttgctttgccacagggtcttcctctgtagcccaggctgacaatgaattcatgactctcacacctcaacctcttaagtagtagatgctgtcattactttgaaaaataataatgaaatcaccatctagacttaggaacaatgtctttttctgatcttccttatgagtcaagggtagctgttatcttagttaacgatttccattgctgtgaagagacaccgtgaccaaggcaagtcttatcaagaacaacatttaattggggctggcttacaggttcagaggttcagtccattatcatcatgggagtaagcatggcagtgtgccagcagacatggtgctggggaaactgagagttctgtgtcttgatccaactacaaccaggagagactatctcatgagcagctaggaggagggtctcaaagcccacctccacagtgacacacttcctccaataaggccatacctcctaatagtgctactcctggaacaagcatattgaaaccaccacagctctcttactgtgacagttgtggcaaggccaactgagttcttgactcctaactgccaggcttctagactctttttgagttacttgatctcaaaggctcaaatactatagctacaccacttcttccacaagcaggtaacatcgaacattatttttccttgggtcaccaggagcctttgtaatcacaagtataaaactgtctagtcacagcccaatattatgacacaggcctggaaatgcagcactaaggaggccaaagcaggaggatcatgactttgagtctactctgagctatataatgccagaaactattttaaaagacagggcttccctgtctttagcttttcaattctttctcaagattatatagttgcacagaggcccatgagcaacgccatcttagtacagcctgggctctcacttggtttctgactggagcccttcagttcctggagttcacttcacctcatagtctggtcgtttcctgagcaacaactcaaattattctgtgcttctggtatgaggataagacacacataaggaaatcagaccatggaaaacactggaataaatgcccaccatcttgagaatgggtaggtgggcccagtggcaggagaggacttaattcaggcagatgaagttttgcttatcctctgtgacttgaggtcagttaatgaagttctggtcagaagaagcaacctgcattttgctttaaaaaaaaaaaaaattgggtttttgttgttgttgttgttgttttgttttgttttgttttgttttgttttgtttttttgagacagggtttctctgtgtagctctggctgtcctggaactcactctgagaaccagactggcctcgaactcagaaatccccctgcctctgcctcctgagtgctgggattaaaggtgtgcgccaccatgcccggtgctttttaaatttttaagtcacatccatagattagcatttttttttaaaaaaatgttatatgtgagggtgttttgcctgtctgtaggtctgcaccacatgcatgcagtgcccagggagtccagaacaaagtgctagatcccatgggaatggagttatacattgttatgagctactatgtgagtgcttggaattaagcccaggtcctctgaaagagcagacagtgctcttaaccactgagccatctctcccatctaagctggtactactagaagttagtctgacacacatcatttcttttagcttggggctaaattccttaagctcaaaaaggatcctttttctgtaccaggaagtgcctaaattgttgaatctcatagacaagggtaactatctgtttatttaaactttcaccaactaaacaagttgttcttaaattctatgctgtatcaagactcagttactatgaacagtccctgccctcaagactcttacagggcagatgggtggttttcatgctttctcactccactgctagaactcccatatacggctgaaactcaagttcaaaaccattgctgtattcctggtagaaatggaaagaattgcagggtttagatgcatactaaggaagtaaaacctcaggccttaagtgagcagcccaaaaatctgagtcaactggaagggctcttaggctggggttctctatggccatgcagaggaagggtgacactgtattcttacagacttctctctttatcaccattgcctgtgtagacctcagtcatgtcacttcggcctgcgagatggtggcagacatggtggaatccctgcagtcagtgctggccttgggccacaagaggaacagcaccctgccttcatttctcacagctgtgctgaagaacattgttatcagtctggcccgactccccctagttaacagctatactcgtgtgcctcctctggtaagttggatcttgctcaatttgatatgtaaccaggcagcaaacttgggattctcctctctacctcccaaagctagaattacatgcccagcttgtcacatagtcttcattattgtgacactccctgtgatagtcccagcattttcatatggttgtgacactgtgttgtcccccaggcattctgtgtagtaggtattagtaaaaatactgcatttcaaaaaactgactgaagtactaaacttcaaaacttcaaaagtgtcacctctgaagagattcgtacagagctgggcatagtggtacatgcagaggcatgcagatctctgagttctaggtcagccagagctacatagtgagactctgtctagagagagagagaaagaaggattgattcatacatttagggacaaccactattgtgggtcttctcttgaaattttcttcatgaatcaacttaaaataggctggttcttaggttttgttccacttcacagtcatggaaatagggttaacaacagctaggctgacctcagtctgctaaaatagcacaccagacatattctttcctacaaaaatcctcatcaagaaagcaaaggtggcccgcagctgatttgaatcatagcgcagagccagaccaggaagccagataagaaagggtgatttattctgcatagatagggcatatgcctgctgctgggccatagctacagcgtgtgtgtgcttgcatgtaagatcctagaaaagttcacatctagaacatgacattcattggaccttagagttgctggggcccagtctgagtgctgtgacccacctatgctggaagtgcttctagaacagagaggtgtggacattgggaagagagcaatagaaagccaagagatcatctaacactgctgcatgaggctcagccctgagcaggagtattccttataaagactgtataagaaggtggtatggggtcatggaaggctcttgtggaatctacctcataggctatgtgctgtaggtaaatctccatcaagagcttttaatccaggccaggcagtggtggtgcacgcctttaatcccagcacttgaaagaccgagacaggtggatttctgagtttgaggacagccagggctacacagaagaaaccctgtctcaaaaaaacaaaaaactcttaatccgataccttgagtgccctgggcagaaaagtagctgtagcaaacactgcagaacctcccctgggcatgctccagagacttctgtgggtggtgtaagagatttatagaaggttggttgtgttgtagaaatctggggaggttcccttaggtcctcgttgctttactgaggcacatagctgagctggctagatggtcctgccactggaacagcgtggggtatacctcagggcttcctttgtgcatggtgcttatctacatatcgaatggcaaaactcagcctctcacagttgatagaaatgagcagtggggttgtccttgagactgaatttcattagtgtttgcctcttttccaacacacttgatgtttgtgggtagcagcatttcctacaaggaatgtggctgtgtacaggcagcctgaggggtgtaacaagcaggtgatgggctggccttgggggagtggggggcagggcagagtgctgggagtcaagcttggcattgaaggttctaggcacaagggtgggagcctctgtgaaagggcacaggctctggacaaatcagagtagtaaaggggggggagggcagttgagagacaagggacactggacgctgggggtctcttgtcctcctcatgccatctccatccacctggcacgctttttatcttctcaggtatggaaactcgggtggtcacccaagcctggaggggattttggcacagtgtttcctgagatccctgtagagttcctccaggagaaggagatcctcaaggagttcatctaccgcatcaacaccctaggtatcccaccacagtcctcttcagtccccatgtgccacctccgagacctgaagcctcagggtagggccatcgcactcggcaactgaaaaggttctggggtggtaatgatgcagtacaaatagaattatggtgaaaagtagacctaggtgtagatggatgagtatagtgtgggggttgcataccaggcttctttgtaactgtcagaggaagccagttctgtcttcacattgtctattcaaactaagccatataggtgggttggggatgtgcttcactgtagtgtttgtctagcacgaggaagcccaggcgtcagtctccagagccgcaacaacagactaagtagtggaagtcatgtcctcatgtcttcctgcttgccactttgacattgtgttctcactcgaatcatttttcttatatgcagaatgagcagcttgggaaaacatggcaagctaggtgtcacagggacagagtgatagaatgagggaaggtagatttggccagacagccctgctcatccctttgctgacagggtaggatcttcagtgctgtggtccatagaatggagactgggtctattttttatgtttgctacggatgtgaacatgaaaaatacacttagtgtctcagtaagcagtagcatgagtagttttcctgtcaggactcttctgctttctgaagcacagtctaaattgctgctgctgctgctgctgcttatcattattattattatacctcctcctccctctcttcctcctcctccctctcctcttcctccttctttgattccttcttttttgcccattttctggatgagggtgtgtcttttgtttttgtttgttttttgttttttgggtttttttgtttttcaagacagggttctctgtgtagccctggctgtcctggaactcactctgtagaccaggctggccttgaactcagaaatccactttcctctgcctcccaagtgctgggattaaaggcgtgcgccaccaccacctgcctgaggatgtgtcttaatcactgttctgtgaagagacaccatgaccaaggcaactcttatgaaggaaaacatttagttggtggcttacttatagtttcagaaagttaattcattatcatcatggcgaaagcagacagtcatggtgccggagcagtagctgagagctttacatcctaatccacaggcagcaggcagagagagggagatagagatagagagacagggcctggtgtgggcttttcaaacctcaaggcccagtcacagtgacaaacctcctccagcaaggccatacctcctaatccttcacaaatagtatatcacctagttaccaaggatgtaaatgtatgagcctatggacaccaatctgacttggttttgtggttatagtcctcatagcctttcccttctggggtatttcctaagagtctggtcaccagacccactgcctggtccaagttaggccctagggattcttcaagttttcttattcggatctcagcaacctacctctacttcatcactgtgcgcagtaactcctgagaaggaatccggcacctcccatgaaggacattttacttccaatcttagttgcttttctgtcgctatgataaacaccatgaccaaaagcaacttgaggaagaaaaggtttatttctctttatagcttataagtatatcactgaaggaagccagggcaggaacacaggacaggaacctagaggcagaaacaggagcagaggccatagaggagcgccacttaccagcttgctcaccaaggcttgctcagcccgctttctcaaagcactcaggactgtcaccccagaggtggttctaccaatataggctgggccctaccacattgatcactaattaagaaaactcccttcaaacttacttataggccaatatttgggggtagcttttcaactgagagttcctcttcctagatgattctagcttgtgtcaagttgacataactagccagcacattgcctttgctcctgcccacttatgccttccctgggcagttatcagttgggtctgtctcctggtgtcagtattcacttgaatctgagttataccccatgttccaggaggtcctagcacttgatgctctacttttctgctcctctttactgcattctggccttacaaggagtgctgtagatatttttgggtcttggtgggaacatcaagtgcagctatttattgaactttctctgattggcctcctagactgctagagtggtcctagcctgataccatgctttttttttttttttttttttaaagtctgtctccggggtggctttcactgtttgcatttacttactttgtggaggcaggacccacgtgaacatctcatagtgcagcatgcacatggagggcagaggacagctgacaggaattggttccctcctccttccatgtggtccctgaattgagaattggactcagattgtcaggcatctcgctggcagtctgtttaatctcactggttttatagagacagaattattatctctatggttctgtggtctgctctgaggtctcacttaaggtgagacttttaaaatgcttcgtgggcaggactagcctaggtgattaatgcctttgtagacagcctgtcactgtcctatacagtgggggattgaagggcaatctggcctgtgcctcttggccttgatagcataactggtctccatgtgctgctatatcctttatgatagatggagagaatggcagccctcatgctgtaggattgctctgaaggtggtgtcctaggagcagcactgatgggattacatcgtcagtgtctcctcatgggtttggcgagtcaggaaactaatgtaatgattgattcccagggtggaccaatcgtacccagttcgaagaaacttgggccaccctccttggtgtcctggtgactcagcccctggtgatggaacaggaagagagcccaccagaggtgagacttccataactagggggtggctaactggaatcctatagctgtgaaagctggtgactctgtgttttgaaacagaaaaacaggctgatcatgtaccaactgatggtgcagagtaaagacaaatgccctgagaggcttggagactgaggcttccagtagctaggttgtgtctttcactacatacattccactctgatgatcaatgaactggttcttcagtactgttatgttttacttacttaccatgatctgaaagaatgtcattgagctaaaacaaaaaagacaatgaatctaggccatgcacatgtacttgtttggttgggttttattgctgttgttgtttgtttgtttgttttaactaacttataggttttgctttgttagcttaattgctttgttagtattaatatgacatgaataaccgccatatatttgtaaaatgaaggaggttctgaatgttaaagtactgggatataagcccttgattctaagaaatatgtagtaaactgtggaaatgacagagaagaaggtaaatctatatagatcacaggccatcagtattatcttcaaactcatctgtaactgccaggctgccataggcagtgttctaaaatgatgatagaatttaagaacaattttctccaaggtaaatttctatttggagttctatgccaaacatttggatactccaagtctcaggtatgtaggtaggtataaccagtgctgagcaaacttggacttaagaccctggctgtgggaagccatagctcttaagtgatctgatattcctgtatgaggccatgtggcctatgggcactgtgtgaattagaggcaggatgagtagttggtatcttcttatcatgttgtcaatgtgtggactgtttctctaggaagacacagaaagaacccagatccatgtcctggctgtgcaggccatcacctctctagtgctcagtgcaatgaccgtgcctgtggctggcaatccagctgtaagctgcttggagcaacagccccggaacaagccactgaaggctctcgataccaggtttgcctgcgttcttatgtgggccagtgcagaggatggtgaggtagcccacttcccctagccctctcctttgtaataagaattgatgtaacaattaattcttactggttctttcagtactgttaattttttcgtctgtggccttgccctgagatacagatacaaaagggatttttgtcaatggtgacaactgagaatttagtctgatatgttatggacttcactgggtgttctggctcagacttgtgggtcaagaatgagcacctactgaagggtttgttttttgttaaaccagctgcttcaggcaagtgaaagataattcctggtggctttcacttctctgatgtttgaaggaagcaaacatgttttttccttggttctgaattttagatttggaagaaagctgagcatgatcagagggattgtagaacaagaaatccaagagatggtttcccagagagagaatactgccactcaccattctcaccaggcgtgggatcctgtcccttctctgttaccagctactacaggtacaggaagaagctagaacaatagtgtggcttaacaaggaggctttgtgctgagtgtattgcccccattcacaagtctcatgcttcgtctagaccaccatgagcatcagggtgtatcacctcacttaaatgaaaagcactttctttccattgtgtatgttaattgtacaaagttttgtatttcataaggacattttcatacaagcacataatgtatattgaatgagccacccccaaaacctccttaccattccctttgcccatcttcccttccctttgctgtccccactatgttattgttgtacaaactgcttccatctcataattactaaattgttttaggaattgtttgttgttgtaaatttaagtaccttgaagactttatttgggaaagtttgtgtatggaaatgcaatgtgtcatttatcccaaaacggttttggcagctttgaagtaaacagagcactgagactttaaatactcatgggacttagaccgtgaggagcttctttctgtgcaggtagcatgggtgagaaatggcatacttgctctggaacgtcttgagagaggtgtggatagatggcatggcagctcagagtacagctgtggggaggacagtagagtaccttgggggagggtgggcagtgtgagatccaatggagttaacttgaggcagccatcgaagaagagatagtctagtttgcccactgggcctgacagctcaacaggctgcaaacggacagtattccaagacctacagcctctgcatagctggagtatcctgcctgtggggagcagtctcattgggcaaatatctgtccaggcaggagcagggtctcatgcagtgctgtgctgatgtttggcaggtgctcttatcagccatgacaagctgctgctgcagatcaacccagagcgggagccaggcaacatgagctacaagctgggccaggtaggtcagttttaccaatccacacccttctataaggactgtaggctggaattataaccactttgagcttgagccacataccacattcagagaaaagtttttatgtactttattctagattttaatatattttacatataagcatacagatgtttataaaacttgtgagacaggagagaaacaagaagcatgaaaggtcagggaggagagaatggagtcagctgagtgctgtcaggcagatgcactactgaaagtttcctggctgctagctgagagggtagctaagtatccagctcagcaggcagctggcagttggacagttcacttcattcagaacagtagggatagctgacagctactgactgtagggtcagggagatgtggtacctgctgcctttctagacaaactcttctgtgccttcctacctttacagagaaacttccaccctaagataagtcacagtgatggttagaatgtgatgtgcttttgatgcagtgtttctgaagatgaggtgatgagtaagatgcctggggctcctgggcacatgatcatattctaggttccatgtccctgttgtcacattgtcccttatggctgtgttgaactcatctgtctgtttccttcagtacttgaggccagctccaatgtctgcaacctgaatgtagtaggactgtgtggggccaaagtatagatttagccctgccttgcctgggatacctgccagctattaaaaaaaactgccgggctgcgctgccactccattttggggaaagagatggtagaaggggctgggcatggagaacactggcacctggagtcacagctcacagcttgtcttcactgaagctgagatctgagatcataaggaaaaatgcaggaggatttgtagaggagcaatcaaaacggaagtcactgttcatcctgagaatgcaaagaccacttcatctgcaactacatttaggagcttggggctcttggctgctccttataccttcctaaaacaaacgcatctccttctgcatccttggagaaatttctgtaaccaagcagcccagaaaatcaggttttataattggaaaacacaaatgagtgggaccaggtgtataaaatccatgtatgggcattctctccagggtgtggtcagctgtcacttagaagcacttagtgtcactctttggtgttgcttttacttcataccctctccagacactcattcaggctttgaacctgaggtcagacattggagctggcctcaagtactgaaggaaacagacagatgagttcaacacagccataagggacaatgtgacaacagggacatggaacctagaatatgatcatgtgcccaggagccccaggcatcttactcatcacctgccaacagtttagaacatttaccttactacccaggggttccactgatagtaacatttgggtctgagtgaatcattactgtggccatatgtgctcagaccaggaagacctgattgtacctacccaagaagaacctgaggcctttacctatgtccttatctctggtgcctgcttctatgacaggtgtccatacactccgtgtggctgggaaataacatcacacccctgagagaggaggaatgggatgaggaagaagaggaagaaagtgatgtccctgcaccaacgtcaccacctgtgtctccagtcaattccaggtttactggctcttttttttttttttttttttttaataagaaatttgagatttcttctcagtcacttatttggggtcctcttgaggctaacctctcatttctgtatggggaaaatatccatgtttcacactctgcagaaaacaccgtgccggggttgatattcactcctgttcgcagtttctgcttgaattgtacagccgatggatcctgccatccagtgcagccagaaggacccccgtcatcctgatcagtgaagtggttcgatctgtaagtttgctttcccctcacccagaggcatctgtacaccatacacacacacttgaacgtgtgcatacacacacacacaatcatgcacaggcacatatgcacacacgtgtactaaatacaagcgacagacacattacacaaacttcacctatatgcaccagataccatatacataaatacacacatgtgccatgcattcaccaaatagatacacagacacatacacacacaaatatatacaaataaacaagcacacacagatacgcacacatagacacatacacacctcatctctaatgtctcagaacctgtaaaggactcctgcaggcctcccaggtatggagggacagaatgtgtgaagttggtggcgagacagatatttttttttcagatccagatcaggtaaatactctgaaatgtaacagcagtgagtggtgtgccttccagagacccagcgtgtctctctcttccagagtagtaacaaacaactgtgtgccttatccttctaagccaatactctccaagaagcactggttcagaagagcagtgtcagagaaggagtagtctcattatacttcactactccacacttcccgacagtcccaaacaaagggtcgtcagtgacatctttcaatatcgtcagggctggatcgaaaggctctaagacactgacttggtctgaaagtgatagagggagctggagagagtggtagttaagaggacaacagctgcttttctgaaggacccggatctgttcccagaacttacacaggggctcacattttaggctgcctttctaacatccctccaggtgtaattcttgttctgattctccatgtctccagcttcttgtagtgtcagacttattcaccgaacgtacccagtttgaaatgatgtatctgacgctgacagaactacggagagtgcacccttcagaagatgagatcctcattcagtacctggtgcctgccacctgtaaggcagctgctgtccttggaatggtgagtgagggtagtgcagaggccgcccccattgaagctgcttgggactgcactgctttgggaccttgtattggtcacatgtgctacatgcatctgcatagttcagagtcctgtcccaagccaagctccctggcacatgtggaccatggctctggtcagctaaaagacttcggtgccttttggtgctgttcccacagagactgggatgtggtgagcatggctggagtacttgtctcccttggctcactgtatgctgttacagtgagcacctctccagaatacagaatgcagaaggtatggtagcactaggacagcacagagtgaaactgggtcacacttctgccagtctgtcacttggcagccccactccatttctctggtggggtctagctcccactgtactgctcagcctacacaggcttccctggtgagcttgttgtcatagtaacctttcacttctactttgagaaatgtagatcttgatccttaacatcatgattttcttggtctagttgtgttgctgtcacaaaacaccttagacagggtaaataaacaacagataggaactgcttataattctcgagactgggaagccccaaatcaaggtgctctgggacgcctggtgtgcacctcctggcttctccagctcatcggcatttcccattattttgctgccgagttatcagcatttagctagtactacttggttgtctttcatatgtacatatttttaggtgcttctcagaacatggttcagacatacacgtgaaagtaatcgcctatgggttctgcctcttgttggagcatattggagggcatcaacactcaggaaaggggacagaccttagactgttgatattggctcttttgtcctgtcacttactattaaattattattgtgtttttaaattatgttaaaatgttatcattaaatgttgaaaattatcatgtttttaatctctgtttcctgggatccaattttgtgacaacataagaaactgtttagggattggaaagatggctcagtggttaagagcacttggttctcttacagaatatctgggttcattcttagcactcacattgtcagctcataaccggcaccctcttctggcttctacaagtacacatgcatatttaccatgtggacacatacatgtataccacatataaaaataagagtaattttaataaggaaacttctttgttcatagacacgtgagtggctgctatgtgtgatgtagttaggactgctggcaggagtagtgtggaagagcctgctggggaccattccccatgggtcatatgtgccatgccctctcttgttagtaagacagtgctattatcactgtggccacaattatctgatggcatcttttacatacctgtgtaaccctgtgcagtctcacagagcagcagtacacatagatcatggcacagcatgactcccacctctccttactgctctgctagaggatctgttgtcactgaacctaggggctagaacaggtatacagcatgggtggccatagcaccatccagagaacaggaacaatgagcacttagtccccctatgtgagcacactcttcaaagcaggcgtcctctgggtgctgtcaggactgaccgtgtgcttgtgggaggtccattttccttcttggggtggcttcagtggcttaactttccttgtaactgtggttttgtgctcaagcccaagttcctcaggcaaaatgtaaatcaaatgcatcaggcaaataaagaatggtcatttttaagaaacgaccccaaggcagaatggcaaatggctccagttcccagctctgtgtatacaagcagcttgcttgaaggcagtgtcttctgagaggcttccagcctgttttgtgctgctacaagctgtgctgcattgcttttccaggggaaagggacgctcacctcagatgcgctactgatgatccaagcccagcttgtgaatcactgtattaactggctttcctcataggaacttgagtgaaggcttatttattggagctgagggaccccaaaacagctgcatactaaaaaattctaccacggcatgggtgataatactcccaaagctacataaatagagtcatagtctcctccttcacttaacctttcccaagaccaggtgcagtgggggcaggatggtgtgcagcatctgataagggaacactagaatcctgtgcttgggagagagagtctggtaggaatacaggtaatcccagctcctctgatttctagatggcataaccatgtcatgtccagaggacagtgtttcacagtatgtgtcagattgtcacttttctttgcccgtcattagatctgcagccttcaacaacgtatcctgatgttatgcttgcaggagtgtggccagagccctaggttgtactgtccttaggaaggactcacagctcaatggggatagcctgggaagggggatgagaaggaagtaactggcaaagactgttaaccctctttagcctgacaccatcagatacagactcccctggagggctagatgaccagaaggcctcttacatcatgagatcaaatgagtccttagccagcctttcctgggggtggggcagtcagacaatgaaatgctgcccttggattgcagaacacaacagcagtcttcagtgctgaaggagtcatgtttcaaggtgtgtactcccacatttagaaaacctagtggaagtgataccatgtcagtcaaggttagcacaaattaatgtcaggagcttcacaactaccaacagaggatccagaccaaggtttattatagtgaagagacatgaggcaaaaatcagctgaaggagaaggttcctgggtaaagcctagaaaaccagtgtgaatactattcctgaatagtcatacagatcacaaatcatccagtaggtagacaaggagcagacaacatatatgagctgttgctacaggggccagcagaactcagaatccagggttgttagaagtagcaggttacaggaacacccgctgcccagcacataccacagctccaaaagagaaagtaagtgtggtcacaaatcacattttcttcataaggtaaaccctctctcaacttgaagtgtttagatagggttggcactgtacaccaacatctcctggatgaatttcaatcattttgtggactctgctatgtgcgcaactattgctaggctctttcaacctcagggaagcaggctgttggcaatcagccatcagtctgcctccaacagctcatgtctgtgcttgtatccaggacaaaactgtggcagagccagtcagccgcctactggagagcacactgaggagcagccacctgcccagccagatcggagccctgcacggcatcctctatgtgttggagtgtgacctcttggatgacactgcaaagcagctcattccagttgttagtgactatctgctgtccaacctcaaaggaatagcccagtgagtggggctggttgggtgggctacaggctttggtgtggtcttaacaaaaacagaaaaaagaaaaaagaaaataaaagtctctaattcgattttcaaagtatatgccagaacagacatggtaacaaatgcttatgatccagcatttaagaaacgaaggcaggccaggtggtggtggcgcacacctttgatcccagcactcgggaggcagaggcaggcagatttctgagtttgaggccagcctggtctacaaagtgagttccagtacagccagcagagctatacagaaaaaccctgtctcgaaaaaccaaaaagaaagaaagaaagaaagaaagaaagaaagaaagaaagaaagaaagaaagaaagaaagaaagaaagaaggaaggaaaggaaggaaaggaaggaaaggaaggaaaggaaggaaaggaaggaaaggaaggaaggaaggaaggaaggaaggaaggaaggaaggaaggaaggaaggaaggaaggaaaggcaggaaaattgacataagcttgaaaccagccagggctacagatgagatcctgtcccaaaaagagtaacagagtgtatgccaggtcctggtaagtagcagacaggaaacccagggaaatagtagttatgagacacaggacacaaatctacatcagatggtttcttggatttttctagcaagatgctctccactggcacttagcacactgctgtgtggatagcagccttatcccgtgctgccagactcagcctcctcttcagtttatgatcagcaccttgtttcctgtgaggcccttttccctgctctgatctcccacctccccctaaagacagctcacatgcagctgtacctggatatgttgctggtccttttgaaaatacgttgggtccatcacagctctatcttagaagcagaaggaggtgttatggtgtgatggagcatagctaggcactcagaggcacgagctagggatgcaacgggtcttggaggaaaagtccaggtgttctgtgacgggattgtagattgagaggtggagagtaaatttggagatggtaaagtcttaggctgacagacagctactgggaggaggtggcattctgacagatgatcagaagtgcattttgggggcccaacaggcagtggcaagttgaactggaacagagatagtggcttgtagccagccttccttgtagtccttggctgaatagtaacctactatgtacagggtgggcaagcagccacccattgcccctgtgatcacacatcctggcctggagcagatttgggtaggttctgtgaaatcataatctgtgctaaggaatgaagaggacacagaggactgaagacaggtaggaggagcttacaagtccaaatcagataatcacatagaccttgctcaatgctttgggcagagggtcctgtacaaaacagtggccagttcctaggagtggcagtgtcatttgaacagatctgaaagggggtagaagagatagagtgtggctcctttgtttatggtgccattggtctaactcatattccagccaggcccctgctgctgccattgggcaaagaggcaccaactggagatcccatgagttagagtgttacaagttagcaaatgcatggagcaaacagacaccctgaagaaccctgactaagaacataaagaatgttcagggagagtgaagtggtctatggacaggtacagaattggagatggcatgctaagctaaggccatgcagctctggagtgtaatccctaggccatccaggtgaaaaggcctggagaagctgacatgaccccagagctctgtactcaatagatgtgggtggataatgctttaaaactgtcccctctgcagacaggcaggggctgctgtatgtgactgggtatgattatgtgtctcccattcttagctgcgtgaacattcacagccagcagcatgtgctggtaatgtgtgccactgctttctacctgatggaaaactaccctctggatgtgggaccagaattttcagcatctgtgatacaggtgagagggctctattgaacataggcaggttaccatattaactgtaccagtgggtcattgtgcttttggggaagataagaataagcctttcttcttgtctagatgtgtggagtaatgctgtctggaagtgaggagtccaccccctccatcatttaccactgtgccctccggggtctggagcggctcctgctgtctgagcagctatctcggctagacacagagtccttggtcaagctaagtgtggacagagtgaatgtacaaagcccacacagggccatggcagccctaggcctgatgctcacctgcatgtacacaggtgagtgagttgtaagggtcatagactcacccaaagactcaagccaggcctcatggtgtggcagtcttagtgtggccctaagacatcctggtcacctttccagaaatttagggctcaaggcaagagagtagctcacatgatatcaccaagtattgatatcagagctgcctctggccactgcatccctgagagttggaagaaagttgggctgggtcctgccttgctagggactgtaatcacctgtttttgaaggatctctgcctatctggtaaagtcctgtttgagccactgagtgcagatttcaaaactcttgggcttctgttctgtatagcctacttagtgtttttgtttcaggaaaggaaaaagccagtccaggcagagcttctgaccccagccctgctacacctgacagcgagtctgtgattgtagctatggagcgagtgtctgttctctttgataggtaagacatgcagcaaatctctacctctaacctcagtagtcattgactgccctagagccacagccagagcagttcttctgtgtgtatttgttcattctcttgaactctaaaatgtatctttgcagccatttttccagtgcatgcatattcacagagcaccacctgcaaaccagactcagagacaactggacccatgcaggtgtacaaccaaaccactgccctggtggatcccataggccactgctgaggaaatagatactcctggagtatagccaagtgctgtggtggggctcaggccatatccacaggaaggaggcatggctaagggtctgagtcacttgtgtacttctcagctgtataccacagttgtgtggcattagtggaataatcataggtcagcggtctttaaggatgctgctgaggtaagggtaaagtgttggatgttgagagaagaatcaacaggagcatagatgggtgtccaattttgaagggaagaaaagttgctgattgacagtagtactctgggtattaggacatacaacagtgaaaagttttggtacattttgatgtggagagtctcttcagtaatatcaccaccccacccttttgctgctattcctttacaaggctgtcccacaactgcattattctccccagagtgggaaagatcaccttgtgcccagatcaatcagggcagcaaaagaacagcctggatatcatctttggcttttaaaactcataccctagttgtggtctgagccccacttggaacattcctgtgggtcaaggacctctgagccttagtccatgatggctctatgggcaaggttgagaggccaagagccagggtgaggctcaaatcagctcctctcatttcaggatccgcaagggatttccctgtgaagccagggttgtggcaaggatcctgcctcagttcctagatgacttctttccacctcaagatgtcatgaacaaagtcattggagagttcctgtccaatcagcagccatacccacagttcatggccactgtagtttacaaggtgagggtgtacttgccttgtggggtaaggacagagcaggaggaggaagggggagccaatcccacacttgccgtaggcctgtcatcagggctagactcatcctttaagatgagtggcagctgtggccccagtcccctcaccccaccccacagtctgaccctgtgctcagggctctcttgtccctaggtttttcagactctgcacagtgctgggcagtcatccatggtccgggactgggtcatgctgtccctgtccaacttcacacaaagaactccagttgccatggccatgtggagcctctcctgcttccttgttagcgcatctaccagcccatgggtttctgcgatgtatccttccttccatgggactttggccaggttccttgttcacttagcatccagttcaggtttcactgaatgttttcaaacctaaactctaaagaacctcacaggtgggtggtggtggcgcacgcctttaatcccagcacttgggaggcagaggcaggaggacttctgagttccaggccagcctggtctacagagtgagttccaggacagccagggctacacagagaaaccctgtctcaaaaaaacaagaaccccacaggtgatgcttacccttccctaaaatgttgacagggacacgaaacagaaggtctaaccatttgccagccagggtttatggcagttttactgctgagggaaagggaagtccaaagggaggcagggcagctcaggccagccagccactggccctgcggctgccccatcatctggcataatctgtccctctgaggttttctcaatgctgcttctcattagctctcatctttacgctgtggtcaccctcctggggaaagccgtaagtaaagctgcagttcccgccctaacagtgatgccaggagttcctcttggcagcctccttctcagtagaccacaagagttactagcagcaaagctgtcttggtggtgacagtacagcctcaccctaagtactgggaaagccttgcaggcagggtgctagctagctctgccctccctgcactggagcagtttgagcaggaacaccagccactagcactgtgtggggagcacagcccaggtaagtgctgttgtgcagagcactgggaaccagcatcctgtctgcactgcatgactcccacttcctgggcctctctgcctacccacccctgtcctcctgggcagacagcaagctgcagctgagaaaggattacaggcagctgctgctgttaatgtggtctaggctgccctctattttggttgccctcagtcttccctgggcctcttggtggacttaggaggggaaccgcttggggaggctgtctttccacccttgccatcgttcctccttaactcttctaccagccttccacatgtcatcagcaggatgggcaaactggaacaggtggatgtgaaccttttctgcctggttgccacagacttctacagacaccagatagaggaggaattcgaccgcagggctttccagtctgtgtttgaggtggtggctgcaccaggaagtccataccacaggctgcttgcttgtttgcaaaatgttcacaaggtcaccacctgctgagtagtgcctgtgggacaaaaggctgaaagaaggcagctgctggggcctgagcctccaggagcctgctccaagcttctgctggggctgccttggccgtgcaggcttccacttgtgtcaagtggacagccaggcaatggcaggagtgctttgcaatgagggctatgcagggaacatgcactatgttggggttgagcctgagtcctgggtcctggcctcgctgcagctggtgacagtgctaggttgaccaggtgtttgtctttttcctagtgttcccctggccatagtcgccaggttgcagctgccctggtatgtggatcagaagtcctagctcttgccagatggttctgagcccgcctgctccactgggctggagagctccctcccacatttacccagtaggcatacctgccacaccagtgtctggacacaaaatgaatggtgtgtggggctgggaactggggctgccaggtgtccagcaccattttcctttctgtgttttcttctcaggagttaaaatttaattatatcagtaaagagattaattttaatgtaacttttcctatgcccgtgtaaagtgtgtgacttggcaaggcctgtgctgcatgtgacaaagtttatggaagtggaggggccttctggccgccactccctctcctgtagctactcagtctagtcgggcaggtccctcctgtagccctcccaacaccctgtggcacttgcacttcatacagctcccttttcttatgcattccattaagccagcacagagagaggtgttggtattgactgcctgtgtgagaatcctgcctgtggcctaactgaggaactgaaaaactgacttccactgttagagttataagaggcttgccctgtggcagctgccctcctctccccttcccaggcatgactgtcaagctatctcctccctggtgttgatgcactctcctagtctctcagcctgggtagaaacagcatctgctggacccaaagtggctatcccaataacctcatccctggttgtggctgacctgcactgtagcctgcccacacaccagctgaccattgtggatgctgtctgtccctttgtatcttctgcatggttgggacctgagaagtgctgacctgattaccccaaaggtgtctctgagctatggtttgttggtttgtctcagtttctcatagtcaagggaaagcttggtgtcctagcaacagttaagaatggacccagagcctcttttgccccttcccatcttgccttctgtcagcccagtagagtacagacctatgcctgtcagagcccagggaggactcagctgacaagatgaggcaccaaagggaaggttcaaaatcaggtcagcctctggcctcagacagcttcccatgctggtcagagccacctcttcccaaagcccaagcccagagtaaccaggtcatgttaatgaaaatgagctaccttcatttcctggcttggtttgggaactctgtttgctgtttgactatatgaccaagcagattttctgctgttccgctaagtcatatctgtatttctcagctgtagagtaggggagtggaatagtttggagatgtttctaggctacacaggaggaaagagcttgcagcctgtgattaactaactgtgcttcagtccatggattgctttcttgagacccttgaatttccctctatctttccatcatgacaagtagccttgctgctgggatgcaaggttccctaccaaacacaggttgtggggagcctcacacttggcctgactctcctcctatctgccctggcaaaaaccaccccaaggcgtggtaacaggaacagtggacatggattaggtctttcaagaggacgttaagggaagctactgaattttaatgaaagaaattcaccaatgcccctttgctgatttagggcttcttcttgtcaccctcaatttcccgcctagaagtgctcggggaccatgtgaaagttcttacagtgctgctgccacactctgaggttggtccaaccgctctgagatgagcatggtgcaggcctgattactcctcatggtagatgttcataaggaaactcaatataaaatctagagccattcaccaggggattatatcagtgagctcaacctcaagtttagttggcctcttgtttagtgtgatcagaaacaattcttagtatggggcaaggacagcctctgccacaaagttgttgtctgctcatgggtgccacaacctagagatgcacctgggtacaggcaggtatgtatttgtgtacacacataaacacacacacaatcctcaaagacatatgcaaggcctctaaaaatgcctgcctgttttttctgaaagcagacttttcttgcaactgccacatacagtcagctttgtgagtctagcatctgagaatgggactcaatttttaaaagtccatagctcattaaagtctcactggagacattgccccacctgtctaactgcaggagggactaaaactttttatcaaattcctcaaaaatctaaagatttccaagctttatttaaaaacaaaagttattttgactatgaggttttaggggtaggaggtgggatgttgtttctgtttccatggtggtactgtcaggaaagattttaataaaaccagggtagaacttttggcaatgcacttcagcatgtttcttctccaaaatgtgcctccctccctcccactgatggcccccttgacatgtaggtgacttagccactgccaagtgccctttatggttctctcattttgtctgcacatgtacccttcaggagggaagaactggagtggaaccacctcctgccctgtagaatgcagtgccagggaagggaccaatcctaacaggtgccttccctggcaggaagtaccttcccgtgagtgagtgaagcagctctgcttccggctcatgggacaggttttatacagcaatagcttgtctcacagccacgtcacaaggagtcttgcctcccattgtggggctgcagaattggtctccttgccacctgtgagcatccttccccacacagtctccttccctccctccttccctccctccctccctccctccctccgtccctccctccctccctcagcattgagcactaggatcatggctgctaccaggacaggcatgaagctgtcctccagggattggtatgtgggagtcgaagacactgagctgctgatgctgggtgtgggctcaggatatcatggttgggaaaagaattgttcctcagtgggtctggagcctccaggaaagaagaaccaatgctgagcagtgtgacaactaaagatgatatcaaggttcagggccaccctccatgtgtgcttgtcacactctagagccatcgaaggaactgctcccctcaagtgtctctggaaacaccctctgccgcaagctgggtgtaagataataggtggcagagacctatctgcagagatttggctgcattctagggggctcctgtccaagccttgctgctgtatgccatgggcttcactgggaactaggagggctgtgatgggtgtgccccggagcccagcctagacctggctgtccatttccaaaaggaaggactgacatgaaatgtatatttaaaatttttaaattgcagatattgtacagttgaattaaagaagcgattaaaccacctgttgttgctgtttgaggcttgctttacttataaaacctcctttctagcatttgaggagagcatcctgcttatctccagtggggcaaggatactaccagcagccatcttgacactgtaaagatcaggcaatactaggtatagaatgagactgtgtgcctggaattgggaccaggcctaggagtattcgcagaccctattgaagtggtctccctgtctgggagatatggtgtgccaagttctcatagttattggcattttaagcctgtcgtgtgagatcctaggtattgtttcagcttccacacattgctccagggttctagaggggtggtgaggctctgtcctcacacaggacacagttagtagtccttggagtctttgcatgctctccaccagcccttctgcctttctggacatgctcctgatccacatggatcctcttctgcccttcaacatgactggtcttaccacctttgtcctgctgtgtctgcaacacctaccctgtcctttgtaggttacaacttcttttaggttgtctatgacattgcctgtcttaccaggtcccttctttagtatctgggctaaacctgaaatgcaggtacttcatccaccaacctgcaggaacaaggctgtttggggaacactttctaaaggcctgtcaagtttcagttgtgaggcaggagttgtctacctgatccttcaacccaccagaccctgacgttagtgccaggataactcttgggagtcttatagagcccagtgcatgccactatcccttctaggacatggcacagggtctgttctctgtacaagataatgaacctttggcaggaagggcctggtaggtgccccaccatgtttaggtctttgcccagtaactcaagcatttgatggcagcatggatgttattgcttcaactccctgaatctacctcagcagtcctctctaggactacggtgatattgcccttaaggtcttcatcaacgccgggcatggtggcacacacctttaatcccatcacttgggagggatttctgagtttgaggccagcctggtctacaatgtgagttccaggacagccagggctatacagagaaaccctgtctacaaaaacaaaaacaaaaagatcttcatcaacacttgagttttgctcacttcaggaaaatgaagtacccctgccctcctggtggatagccagacctttgacctaacaggcatgggtggtattccagaaaggataaggtaagcctccctggggtattggcagcacattattccttctagccactaaagcagaacgcaagccctcaccatagcaagtccagccctcctgcctggggaatgtaggagcacatgacttgaggtacccctcagcctcattgtggtgtttgtctccagtttttccaaaaagcattctgaaggagcttgaagaagcagcctgattgtgttgaatacggggatgggtagtcatggtatgtgtgccatttgtggccatatgtgtccacatattgagtggacagggtccaagtttcctggagttatatccaggcttcctaggatgtgagcctcacctccatacaaggtggcaaagctcagccaaatcaagaagacctacttgggtagcccagggaaggctcatgagcagaggtggacccaggtacttgagaatcactgagaccttcctgggatccacacacatccttagccctgaaagcctgagtctcatcttcctccatgttgtggtcctgaaagagatgcctgcttcacttcaagctcagggtggacatttgggacatagctggggtgggaagagctggccacaaaggcagagtg

SEQ ID NO: 12 - DNA, 20 bp, Artificial Sequence
  Oligomeric Compound
cgtgtgtctgtgctagtccc

SEQ ID NO: 13 - DNA, 20 bp, Artificial Sequence
  Oligomeric Compound
ggcaacgtgaacaggtccaa

SEQ ID NO: 14 - DNA, 18 bp, Artificial Sequence
  Oligomeric Compound
gcccattgctggacatgc

SEQ ID NO: 15 - DNA, 20 bp, Artificial Sequence
  Oligomeric Compound
agcccattgctggacatgca

SEQ ID NO: 16 - DNA, 20 bp, Artificial Sequence
  Oligomeric Compound
ttgtcccagtcccaggcctc

SEQ ID NO: 17 - DNA, 20 bp, Artificial Sequence
  Oligomeric Compound
ctttccgttggacccctggg

SEQ ID NO: 18 - DNA, 20 bp, Artificial Sequence
  Oligomeric Compound
gtgcgcgcgagcccgaaatc

SEQ ID NO: 19 - DNA, 20 bp, Artificial Sequence
  Oligomeric Compound
atccaagtgctactgtagta

SEQ ID NO: 20 - DNA, 20 bp, Artificial Sequence
  Oligomeric Compound
  misc_feature 1-20: n is a, c, g, or t
nnnnnnnnnnnnnnnnnnnn

SEQ ID NO: 21 - DNA, 20 bp, Artificial Sequence
  Oligomeric Compound
gccctccatgctggcacagg

SEQ ID NO: 22 - DNA, 20 bp, Artificial Sequence
  Oligomeric Compound
agcaaaagatcaatccgtta

SEQ ID NO: 23 - DNA, 20 bp, Artificial Sequence
  Oligomeric Compound
tacagaaggctgggccttga

SEQ ID NO: 24 - DNA, 20 bp, Artificial Sequence
  Oligomeric Compound
atgcattctgcccccaagga

SEQ ID NO: 25 - DNA, 21 bp, Artificial Sequence
  Forward Primer
caacggatttggtcgtattgg

SEQ ID NO: 26 - DNA, 26 bp, Artificial Sequence
  Reverse Primer
ggcaacaatatccactttaccagagt

SEQ ID NO: 27 - DNA, 21 bp, Artificial Sequence
  Probe
cgcctggtcaccagggctgct

SEQ ID NO: 28 - DNA, 19 bp, Artificial Sequence
  Forward Primer
gaaggtgaaggtcggagtc

SEQ ID NO: 29 - DNA, 20 bp, Artificial Sequence
  Reverse Primer
gaagatggtgatgggatttc

SEQ ID NO: 30 - DNA, 20 bp, Artificial Sequence
  Probe
caagcttcccgttctcagcc

SEQ ID NO: 31 - DNA, 20 bp, Artificial Sequence
  Probe
tggaatcatattggaacatg

SEQ ID NO: 32 - DNA, 20 bp, Artificial Sequence
  Forward Primer
ggcaaattcaacggcacagt

SEQ ID NO: 33 - DNA, 20 bp, Artificial Sequence
  Reverse Primer
gggtctcgctcctggaagat

SEQ ID NO: 34 - DNA, 27 bp, Artificial Sequence
  Probe
aaggccgagaatgggaagcttgtcatc

SEQ ID NO: 35 - DNA, 23 bp, Artificial Sequence
  Forward Primer
tgttctagagacagccgcatctt

SEQ ID NO: 36 - DNA, 21 bp, Artificial Sequence
  Reverse Primer
caccgaccttcaccatcttgt

SEQ ID NO: 37 - DNA, 24 bp, Artificial Sequence
  Probe
ttgtgcagtgccagcctcgtctca

SEQ ID NO: 38 - DNA, 20 bp, Artificial Sequence
  Forward Primer
ctccgtccggtagacatgct

SEQ ID NO: 39 - DNA, 23 bp, Artificial Sequence
  Reverse Primer
ggaaatcagaaccctcaaaatgg

SEQ ID NO: 40 - DNA, 29 bp, Artificial Sequence
  Probe
tgagcactgttcaactgtggatatcggga

SEQ ID NO: 41 - DNA, 21 bp, Artificial Sequence
  Forward Primer
cagagctggtcaaccgtatcc

SEQ ID NO: 42 - DNA, 21 bp, Artificial Sequence
  Reverse Primer
ggcttaaacagggagccaaaa

SEQ ID NO: 43 - DNA, 26 bp, Artificial Sequence
  Probe
acttcatgatgagctcggagttcaac

SEQ ID NO: 44 - DNA, 13210 bp, H. sapiens
gcactcgccgcgagggttgccgggacgggcccaagatggctgagcgccttggttccgcttctgcctgccgcgcagagccccattcattgccttgctgctaagtggcgccgcgtagtgccagtaggctccaagtcttcagggtctgtcccatcgggcaggaagccgtcatggcaaccctggaaaagctgatgaaggctttcgagtcgctcaagtcgtttcagcagcaacagcagcagcagccaccgccgcaggcgccgccgccaccgccgccgccgcctccgcctcaaccccctcagccgccgcctcaggggcagccgccgccgccaccaccgccgctgccaggtccggcagaggaaccgctgcaccgaccaaagaaggaactctcagccaccaagaaagaccgtgtgaatcattgtctaacaatatgtgaaaacattgtggcacagtctctcagaaattctccagaatttcagaaactcttgggcatcgctatggaactgtttctgctgtgcagtgacgatgcggagtcagatgtcagaatggtggctgatgagtgcctcaacaaagtcatcaaagctttgatggattctaatcttccaaggctacagttagaactctataaggaaattaaaaagaatggtgctcctcgaagtttgcgtgctgccctgtggaggtttgctgagctggctcacctggttcgacctcagaagtgcaggccttacctggtgaatcttcttccatgcctgacccgaacaagcaaaagaccggaggaatcagttcaggagaccttggctgcagctgttcctaaaattatggcttcttttggcaatttcgcaaatgacaatgaaattaaggttctgttgaaagctttcatagcaaatctgaagtcaagctctcccaccgtgcggcggacagcagccggctcagccgtgagcatctgccaacattctaggaggacacagtacttctacaactggctccttaatgtcctcctaggtctgctggttcccatggaagaagagcactccactctcctgatcctcggtgtgttgctcacattgaggtgtctagtgcccttgctccagcagcaggtcaaggacacaagtctaaaaggcagctttggggtgacacggaaagaaatggaagtctctccttctacagagcagcttgtccaggtttatgaactgactttgcatcatactcagcaccaagaccacaatgtggtgacaggggcactggagctcctgcagcagctcttccgtacccctccacctgaactcctgcaagcactgaccacaccaggagggcttgggcagctcactctggttcaagaagaggcccggggccgaggccgcagcgggagcatcgtggagcttttagctggagggggttcctcgtgcagccctgtcctctcaagaaagcagaaaggcaaagtgctcttaggagaggaagaagccttggaagatgactcggagtccaggtcagatgtcagcagctcagcctttgcagcctctgtgaagagtgagattggtggagagctcgctgcttcttcaggtgtttccactcctggttctgttggtcacgacatcatcactgagcagcctagatcccagcacacacttcaagcagactctgtggatttgtccggctgtgacctgaccagtgctgctactgatggggatgaggaggacatcttgagccacagctccagccagttcagtgctgtcccatccgaccctgccatggacctgaatgatgggacccaggcctcctcacccatcagtgacagttctcagaccaccactgaaggacctgattcagctgtgactccttcggacagttctgaaattgtgttagatggtgccgatagccagtatttaggcatgcagataggacagccacaggaggacgatgaggagggagctgcaggtgttctttctggtgaagtctcagatgttttcagaaactcttctctggcccttcaacaggcacacttgttggaaagaatgggccatagcaggcagccttccgacagcagtatagataagtatgtaacaagagatgaggttgctgaagccagtgatccagaaagcaagccttgccgaatcaaaggtgacataggacagcctaatgatgatgattctgctcctctggtacattgtgtccgtcttttatctgcttcctttttgttaactggtgaaaagaaagcactggttccagacagagacgtgagagtcagtgtgaaggccctggccctcagctgcattggtgcggctgtggcccttcatccagagtcgttcttcagcagactgtacaaagtacctcttaataccacggaaagtactgaggaacagtatgtttctgacatcttgaactacatcgatcatggagacccacaggtccgaggagctactgccattctctgtgggacccttgtctactccatcctcagtaggtcccgtctccgtgttggtgactggctgggcaacatcagaaccctgacaggaaatacattttctctggtggactgcattcctttactgcagaaaacgttgaaggatgaatcttctgttacttgcaagttggcttgtacagctgtgaggcactgtgtcctgagtctttgcagcagcagctacagtgacttgggattacaactgcttattgatatgctgcctctgaagaacagctcctactggctggtgaggaccgaactgctggacactctggcagagattgacttcaggctcgtgagttttttggaggcaaaagcagaaagtttacaccgaggggctcatcattatacagggtttctaaaactacaagaacgagtactcaataatgtggtcatttatttgcttggagatgaagaccccagggttcgacatgttgctgcaacatcattaacaaggcttgtcccaaagctgttttacaagtgtgaccaaggacaagctgatccagttgtggctgtagcgagggatcagagcagtgtctacctgaagctcctcatgcatgagacccagccaccatcacacttttctgtcagcaccatcaccagaatctatagaggctatagcttactgccaagtataacagatgtcaccatggaaaacaatctctcaagagttgttgccgcagtttctcatgaactcattacgtcaacaacacgggcactcacatttggatgctgtgaagccttgtgtcttctctcagcagcctttccagtttgcacttggagtttaggatggcactgtggagtgcccccactgagtgcctctgatgagtccaggaagagctgcactgttgggatggcctccatgattctcaccttgctttcatcagcttggttcccactggatctctcagcccatcaggatgccttgattttggctggaaacttgctagcagcgagtgcccccaagtctctgagaagttcatggacctctgaagaagaagccaactcagcagccaccagacaggaggaaatctggcctgctctgggggatcggactctagtgcccttggtggagcagcttttctcccacctgctgaaggtgatcaatatctgtgctcatgtcttggacgatgtgactcctggaccagcaatcaaggcagccttgccttctctaacaaaccccccttctctaagtcctattcgacggaaagggaaggagaaagaacctggagaacaagcttctactccaatgagtcccaagaaagttggtgaggccagtgcagcctctcgacaatcagacacctcaggacctgtcacagcaagtaaatcatcctcactggggagtttctaccatctcccctcctacctcaaactgcatgatgtcctgaaagccactcacgccaactataaggtcaccttagatcttcagaacagcactgaaaagtttggggggttcctgcgctctgccttggacgtcctttctcagattctagagctggcgacactgcaggacattggaaagtgtgttgaagaggtccttggatacctgaaatcctgctttagtcgagaaccaatgatggcaactgtctgtgtgcagcagctattgaagactctctttgggacaaacttagcctcacagtttgatggcttatcttccaaccccagcaagtctcagtgccgagctcagcgccttggctcttcaagtgtgaggcccggcttatatcactactgcttcatggcaccatacacgcacttcacacaggccttggctgacgcaagcctgaggaacatggtgcaggcggagcaggagcgtgatgcctcggggtggtttgatgtactccagaaagtgtctgcccaattgaagacgaacctaacaagcgtcacaaagaaccgtgcagataagaatgctattcataatcacattaggttatttgagcctcttgttataaaagcattgaagcagtacaccacgacaacatctgtacaattgcagaagcaggttttggatttgctggcacagctggttcagctacgggtcaattactgtctactggattcagaccaggtgttcatcgggtttgtgctgaagcagtttgagtacattgaagtgggccagttcagggaatcagaggcaattattccaaatatatttttcttcctggtattactgtcttatgagcgctaccattcaaaacagatcattggaattcctaaaatcatccagctgtgtgatggcatcatggccagtggaaggaaggccgttacacatgctatacctgctctgcagcccattgtccatgacctctttgtgttacgaggaacaaataaagctgatgcagggaaagagcttgagacacagaaggaggtggtggtctccatgctgttacgactcatccagtaccatcaggtgctggagatgttcatccttgtcctgcagcagtgccacaaggagaatgaggacaagtggaaacggctctctcggcaggtcgcagacatcatcctgcccatgttggccaagcagcagatgcatattgactctcatgaagcccttggagtgttaaataccttgtttgagattttggctccttcctccctacgtcctgtggacatgcttttgcggagtatgttcatcactccaagcacaatggcatctgtaagcactgtgcagctgtggatatctggaatcctcgccattctgagggttctcatttcccagtcaaccgaggacattgttctttgtcgtattcaggagctctccttctctccacacttgctctcctgtccagtgattaacaggttaaggggtggaggcggtaatgtaacactaggagaatgcagcgaagggaaacaaaagagtttgccagaagatacattctcaaggtttcttttacagctggttggtattcttctagaagacatcgttacaaaacagctcaaagtggacatgagtgaacagcagcatacgttctactgccaagagctaggcacactgctcatgtgtctgatccacatattcaaatctggaatgttccggagaatcacagcagctgccactagactcttcaccagtgatggctgtgaaggcagcttctatactctagagagcctgaatgcacgggtccgatccatggtgcccacgcacccagccctggtactgctctggtgtcagatcctacttctcatcaaccacactgaccaccggtggtgggcagaggtgcagcagacacccaagagacacagtctgtcctgcacgaagtcacttaacccccagaagtctggcgaagaggaggattctggctcggcagctcagctgggaatgtgcaatagagaaatagtgcgaagaggggcccttattctcttctgtgattatgtctgtcagaatctccatgactcagaacacttaacatggctcattgtgaatcacattcaagatctgatcagcttgtctcatgagcctccagtacaagactttattagtgccattcatcgtaattctgcagctagtggtctttttatccaggcaattcagtctcgctgtgaaaatctttcaacgccaaccactctgaagaaaacacttcagtgcttggaaggcatccatctcagccagtctggtgctgtgctcacactatatgtggacaggctcctgggcacccccttccgtgcgctggctcgcatggtcgacaccctggcctgtcgccgggtagaaatgcttttggctgcaaatttacagagcagcatggcccagttgccagaggaggaactaaacagaatccaagaacacctccagaacagtgggcttgcacaaagacaccaaaggctctattcactgctggacagattccgactctctactgtgcaggactcacttagccccttgcccccagtcacttcccacccactggatggggatgggcacacatctctggaaacagtgagtccagacaaagactggtacctccagcttgtcagatcccagtgttggaccagatcagattctgcactgctggaaggtgcagagctggtcaaccgtatccctgctgaagatatgaatgacttcatgatgagctcggagttcaacctaagccttttggctccctgtttaagccttggcatgagcgagattgctaatggccaaaagagtcccctctttgaagcagcccgtggggtgattctgaaccgggtgaccagtgttgttcagcagcttcctgctgtccatcaagtcttccagcccttcctgcctatagagcccacggcctactggaacaagttgaatgatctgcttggtgataccacatcataccagtctctgaccatacttgcccgtgccctggcacagtacctggtggtgctctccaaagtgcctgctcatttgcaccttcctcctgagaaggagggggacacggtgaagtttgtggtaatgacagttgaggccctgtcatggcatttgatccatgagcagatcccactgagtctggacctccaagccgggctagactgctgctgcctggcactacaggtgcctggcctctggggggtgctgtcctccccagagtacgtgactcatgcctgctccctcatccattgtgtgcgattcatcctggaagccattgcagtacaacctggagaccagcttctcggtcctgaaagcaggtcacatactccaagagctgtcagaaaggaggaagtagactcagatatacaaaacctcagtcatgtcacttcggcctgcgagatggtggcagacatggtggaatccctgcagtcagtgctggccttgggccacaagaggaacagcaccctgccttcatttctcacagctgtgctgaagaacattgttatcagtctggcccgactccccctagttaacagctatactcgtgtgcctcctctggtatggaaactcgggtggtcacccaagcctggaggggattttggcacagtgtttcctgagatccctgtagagttcctccaggagaaggagatcctcaaggagttcatctaccgcatcaacaccctagggtggaccaatcgtacccagttcgaagaaacttgggccaccctccttggtgtcctggtgactcagcccctggtgatggaacaggaagagagcccaccagaggaagacacagaaagaacccagatccatgtcctggctgtgcaggccatcacctctctagtgctcagtgcaatgaccgtgcctgtggctggcaatccagctgtaagctgcttggagcaacagccccggaacaagccactgaaggctctcgataccagatttggaagaaagctgagcatgatcagagggattgtagaacaagaaatccaagagatggtttcccagagagagaatactgccactcaccattctcaccaggcgtgggatcctgtcccttctctgttaccagctactacaggtgctcttatcagccatgacaagctgctgctgcagatcaacccagagcgggagccaggcaacatgagctacaagctgggccaggtgtccatacactccgtgtggctgggaaataacatcacacccctgagagaggaggaatgggatgaggaagaagaggaagaaagtgatgtccctgcaccaacgtcaccacctgtgtctccagtcaattccagaaaacaccgtgccggggttgatattcactcctgttcgcagtttctgcttgaattgtacagccgatggatcctgccatccagtgcagccagaaggacccccgtcatcctgatcagtgaagtggttcgatctcttcttgtagtgtcagacttattcaccgaacgtacccagtttgaaatgatgtatctgacgctgacagaactacggagagtgcacccttcagaagatgagatcctcattcagtacctggtgcctgccacctgtaaggcagctgctgtccttggaatggacaaaactgtggcagagccagtcagccgcctactggagagcacactgaggagcagccacctgcccagccagatcggagccctgcacggcatcctctatgtgttggagtgtgacctcttggatgacactgcaaagcagctcattccagttgttagtgactatctgctgtccaacctcaaaggaatagcccactgcgtgaacattcacagccagcagcatgtgctggtaatgtgtgccactgctttctacctgatggaaaactaccctctggatgtgggaccagaattttcagcatctgtgatacagatgtgtggagtaatgctgtctggaagtgaggagtccaccccctccatcatttaccactgtgccctccggggtctggagcggctcctgctgtctgagcagctatctcggctagacacagagtccttggtcaagctaagtgtggacagagtgaatgtacaaagcccacacagggccatggcagccctaggcctgatgctcacctgcatgtacacaggaaaggaaaaagccagtccaggcagagcttctgaccccagccctgctacacctgacagcgagtctgtgattgtagctatggagcgagtgtctgttctctttgataggatccgcaagggatttccctgtgaagccagggttgtggcaaggatcctgcctcagttcctagatgacttctttccacctcaagatgtcatgaacaaagtcattggagagttcctgtccaatcagcagccatacccacagttcatggccactgtagtttacaaggtttttcagactctgcacagtgctgggcagtcatccatggtccgggactgggtcatgctgtccctgtccaacttcacacaaagaactccagttgccatggccatgtggagcctctcctgcttccttgttagcgcatctaccagcccatgggtttctgcgatccttccacatgtcatcagcaggatgggcaaactggaacaggtggatgtgaaccttttctgcctggttgccacagacttctacagacaccagatagaggaggaattcgaccgcagggctttccagtctgtgtttgaggtggtggctgcaccaggaagtccataccacaggctgcttgcttgtttgcaaaatgttcacaaggtcaccacctgctgagtagtgcctgtgggacaaaaggctgaaagaaggcagctgctggggcctgagcctccaggagcctgctccaagcttctgctggggctgccttggccgtgcaggcttccacttgtgtcaagtggacagccaggcaatggcaggagtgctttgcaatgagggctatgcagggaacatgcactatgttggggttgagcctgagtcctgggtcctggcctcgctgcagctggtgacagtgctaggttgaccaggtgtttgtctttttcctagtgttcccctggccatagtcgccaggttgcagctgccctggtatgtggatcagaagtcctagctcttgccagatggttctgagcccgcctgctccactgggctggagagctccctcccacatttacccagtaggcatacctgccacaccagtgtctggacacaaaatgaatggtgtgtggggctgggaactggggctgccaggtgtccagcaccattttcctttctgtgttttcttctcaggagttaaaatttaattatatcagtaaagagattaattttaatgtaacttttcctatgcccgtgtaaagtgtgtgacttggcaaggcctgtgctgcatgtgacaaagtttatggaagtggaggggccttctggccgccactccctctcctgtagctactcagtctagtcgggcaggtccctcctgtagccctcccaacaccctgtggcacttgcacttcatacagctcccttttcttatgcattccattaagccagcacagagagaggtgttggtattgactgcctgtgtgagaatcctgcctgtggcctaactgaggaactgaaaaactgacttccactgttagagttataagaggcttgccctgtggcagctgccctcctctccccttcccaggcatgactgtcaagctatctcctccctggtgttgatgcactctcctagtctctcagcctgggtagaaacagcatctgctggacccaaagtggctatcccaataacctcatccctggttgtggctgacctgcactgtagcctgcccacacaccagctgaccattgtggatgctgtctgtccctttgtatcttctgcatggttgggacctgagaagtgctgacctgattaccccaaaggtgtctctgagctatggtttgttggtttgtctcagtttctcatagtcaagggaaagcttggtgtcctagcaacagttaagaatggacccagagcctcttttgccccttcccatcttgccttctgtcagcccagtagagtacagacctatgcctgtcagagcccagggaggactcagctgacaagatgaggcaccaaagggaaggttcaaaatcaggtcagcctctggcctcagacagcttcccatgctggtcagagccacctcttcccaaagcccaagcccagagtaaccaggtcatgttaatgaaaatgagctaccttcatttcctggcttggtttgggaactctgtttgctgtttgactatatgaccaagcagattttctgctgttccgctaagtcatatctgtatttctcagctgtagagtaggggagtggaatagtttggagatgtttctaggctacacaggaggaaagagcttgcagcctgtgattaactaactgtgcttcagtccatggattgctttcttgagacccttgaatttccctctatctttccatcatgacaagtagccttgctgctgggatgcaaggttccctaccaaacacaggttgtggggagcctcacacttggcctgactctcctcctatctgccctggcaaaaaccaccccaaggcgtggtaacaggaacagtggacatggattaggtctttcaagaggacgttaagggaagctactgaattttaatgaaagaaattcaccaatgcccctttgctgatttagggcttcttcttgtcaccctcaatttcccgcctagaagtgctcggggaccatgtgaaagttcttacagtgctgctgccacactctgaggttggtccaaccgctctgagatgagcatggtgcaggcctgattactcctcatggtagatgttcataaggaaactcaatataaaatctagagccattcaccaggggattatatcagtgagctcaacctcaagtttagttggcctcttgtttagtgtgatcagaaacaattcttagtatggggcaaggacagcctctgccacaaagttgttgtctgctcatgggtgccacaacctagagatgcacctgggtacaggcaggtatgtatttgtgtacacacataaacacacacacaatcctcaaagacatatgcaaggcctctaaaaatgcctgcctgttttttctgaaagcagacttttcttgcaactgccacatacagtcagctttgtgagtctagcatctgagaatgggactcaatttttaaaagtccatagctcattaaagtctcactggagacattgccccacctgtctaactgcaggagggactaaaactttttatcaaattcctcaaaaatctaaagatttccaagctttatttaaaaacaaaagttattttgactatgaggttttaggggtaggaggtgggatgttgtttctgtttccatggtggtactgtcaggaaagattttaataaaaccagggtagaacttttggcaatgcacttcagcatgtttcttctccaaaatgtgcctccctccctcccactgatggcccccttgacatgtaggtgacttagccactgccaagtgccctttatggttctctcattttgtctgcacatgtacccttcaggagggaagaactggagtggaaccacctcctgccctgtagaatgcagtgccagggaagggaccaatcctaacaggtgccttccctggcaggaagtaccttcccgtgagtgagtgaagcagctctgcttccggctcatgggacaggttttatacagcaatagcttgtctcacagccacgtcacaaggagtcttgcctcccattgtggggctgcagaattggtctccttgccacctgtgagcatccttccccacacagtctccttccctccctccttccctccctccctccctccctccctccgtccctccctccctccctcagcattgagcactaggatcatggctgctaccaggacaggcatgaagctgtcctccagggattggtatgtgggagtcgaagacactgagctgctgatgctgggtgtgggctcaggatatcatggttgggaaaagaattgttcctcagtgggtctggagcctccaggaaagaagaaccaatgctgagcagtgtgacaactaaagatgatatcaaggttcagggccaccctccatgtgtgcttgtcacactctagagccatcgaaggaactgctcccctcaagtgtctctggaaacaccctctgccgcaagctgggtgtaagataataggtggcagagacctatctgcagagatttggctgcattctagggggctcctgtccaagccttgctgctgtatgccatgggcttcactgggaactaggagggctgtgatgggtgtgccccggagcccagcctagacctggctgtccatttccaaaaggaaggactgacatgaaatgtatatttaaaatttttaaattgcagatattgtacagttgaattaaagaagcgattaaaccacctgtt

SEQ ID NO: 45 - DNA, 1876 bp, Mus musculus
cgcccaccctctccccgtgcagagagccccgcagctggctccccgcagggctgtccgggtgagtatggctctggccacgggccagtgtggcgggagggcaaaccccaaggccacctcggctcagagtccacggccggctgtcgccccgctccaggcgtcggcgggggatcctttccgcatgggcctgcgcccgcgctcggcgccccctccacggccccgccccgtccatggccccgtccttcatgggcgagcccctccatggccctgcccctccgcgccccacccctccctcgccccacctctcaccttcctgccccgcccccagcctccccaaccctcaccggccagtcccctcccctatcccgtccgcccctcagccgccccgcccctcagccggcctgcctaatgtccccgtccccagcatcgccccgccccgcccccgtctcgccccgcccctcaggcggcctccctgctgtgccccgccccggcctcgccacgcccctacctcaccacgccccccgcatcgccacgccccccgcatcgccacgcctcccttaccatgcagtcccgccccgtcccttcctcgtcccgcctcgccgcgacacttcacacacagcttcgcctcaccccattacagtctcaccacgccccgtcccctctccgttgagccccgcgccttcgcccgggtggggcgctgcgctgtcagcggccttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcagcgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcaacagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccgtgagtttgggcccgctgcagctccctgtcccggcgggtcccaggctacggcggggatggcggtaaccctgcagcctgcgggccggcgacacgaacccccggccccgcagagacagagtgacccagcaacccagagcccatgagggacacccgccccctcctggggcgaggccttcccccacttcagccccgctccctcacttgggtcttcccttgtcctctcgcgaggggaggcagagccttgttggggcctgtcctg

SEQ ID NO: 46 - DNA, 20 bp, Artificial Sequence
  Oligomeric Compound
caggtaaaagcagaacctga

SEQ ID NO: 47 - DNA, 20 bp, Artificial Sequence
  Oligomeric Compound
gccttcatcagcttttccag

SEQ ID NO: 48 - DNA, 20 bp, Artificial Sequence
  Oligomeric Compound
gctgctgctgctgctggaag

SEQ ID NO: 49 - DNA, 20 bp, Artificial Sequence
  Oligomeric Compound
tgctgctgctgctgctgctg

SEQ ID NO: 50 - DNA, 20 bp, Artificial Sequence
  Oligomeric Compound
ctgctgctgttgctgctgct

SEQ ID NO: 51 - DNA, 20 bp, Artificial Sequence
  Oligomeric Compound
ctgctgctgctgctgctgct

SEQ ID NO: 52 - DNA, 20 bp, Artificial Sequence
  Oligomeric Compound
gctgctgctgctgctgctgc

SEQ ID NO: 53 - DNA, 20 bp, Artificial Sequence
  Oligomeric Compound
tggcggctgctgctgctgct

SEQ ID NO: 54 - DNA, 20 bp, Artificial Sequence
  Oligomeric Compound
gcggcggcggcggtggcggc

SEQ ID NO: 55 - DNA, 20 bp, Artificial Sequence
  Oligomeric Compound
atgattcacacggtctttct

SEQ ID NO: 56 - DNA, 20 bp, Artificial Sequence
  Oligomeric Compound
aaattctggagaatttctga

SEQ ID NO: 57 - DNA, 20 bp, Artificial Sequence
  Oligomeric Compound
agtttctgaaattctggaga

SEQ ID NO: 58 - DNA, 20 bp, Artificial Sequence
  Oligomeric Compound
gaatccatcaaagctttgat

SEQ ID NO: 59 - DNA, 20 bp, Artificial Sequence
  Oligomeric Compound
ccttggaagattagaatcca

SEQ ID NO: 60 - DNA, 20 bp, Artificial Sequence
  Oligomeric Compound
gagccagctcagcaaacctc

SEQ ID NO: 61 - DNA, 20 bp, Artificial Sequence
  Oligomeric Compound
gaaccaggtgagccagctca

SEQ ID NO: 62 - DNA, 20 bp, Artificial Sequence
  Oligomeric Compound
ttcaccaggtaaggcctgca

SEQ ID NO: 63 - DNA, 20 bp, Artificial Sequence
  Oligomeric Compound
acagctgcagccaaggtctc

SEQ ID NO: 64 - DNA, 20 bp, Artificial Sequence
  Oligomeric Compound
ccaaaagaagccataatttt

SEQ ID NO: 65 - DNA, 20 bp, Artificial Sequence
  Oligomeric Compound
aaccttaatttcattgtcat

SEQ ID NO: 66 - DNA, 20 bp, Artificial Sequence
  Oligomeric Compound
gtagccaactatagaaatat

SEQ ID NO: 67 - DNA, 20 bp, Artificial Sequence
  Oligomeric Compound
atttagtagccaactataga

SEQ ID NO: 68 - DNA, 20 bp, Artificial Sequence
  Oligomeric Compound
agagacttccatttctttcc

SEQ ID NO: 69 - DNA, 20 bp, Artificial Sequence
  Oligomeric Compound
agaaggagagacttccattt

SEQ ID NO: 70 - DNA, 20 bp, Artificial Sequence
  Oligomeric Compound
tgctctgcagaaggagagac

SEQ ID NO: 71 - DNA, 20 bp, Artificial Sequence
  Oligomeric Compound
cataaacctggacaagctgc

SEQ ID NO: 72 - DNA, 20 bp, Artificial Sequence
  Oligomeric Compound
gtcagttcataaacctggac

SEQ ID NO: 73 - DNA, 20 bp, Artificial Sequence
  Oligomeric Compound
acattgtggtcttggtgctg

SEQ ID NO: 74 - DNA, 20 bp, Artificial Sequence
  Oligomeric Compound
aagagcactttgcctttttg

SEQ ID NO: 75 - DNA, 20 bp, Artificial Sequence
  Oligomeric Compound
tgctgaccctggagtggaaa

SEQ ID NO: 76 - DNA, 20 bp, Artificial Sequence
  Oligomeric Compound
tggccagatccactgagtcc

SEQ ID NO: 77 - DNA, 20 bp, Artificial Sequence
  Oligomeric Compound
tcattcaggtccatggcagg

SEQ ID NO: 78 - DNA, 20 bp, Artificial Sequence
  Oligomeric Compound
ggtcccatcattcaggtcca

SEQ ID NO: 79 - DNA, 20 bp, Artificial Sequence
  Oligomeric Compound
ctaacacaatttcagaactg

SEQ ID NO: 80 - DNA, 20 bp, Artificial Sequence
  Oligomeric Compound
tggaagagttcctgaaggcc

SEQ ID NO: 81 - DNA, 20 bp, Artificial Sequence
  Oligomeric Compound
gtttttcaataaatgtgcct

SEQ ID NO: 82 - DNA, 20 bp, Artificial Sequence
  Oligomeric Compound
gcagtgactcatgtttttca

SEQ ID NO: 83 - DNA, 20 bp, Artificial Sequence
  Oligomeric Compound
tgcctgcagtgactcatgtt

SEQ ID NO: 84 - DNA, 20 bp, Artificial Sequence
  Oligomeric Compound
gtcaagaggaactttataga

SEQ ID NO: 85 - DNA, 20 bp, Artificial Sequence
  Oligomeric Compound
atcgatgtagttcaagatgt

SEQ ID NO: 86 - DNA, 20 bp, Artificial Sequence
  Oligomeric Compound
gtcccacagagaatggcagt

SEQ ID NO: 87 - DNA, 20 bp, Artificial Sequence
  Oligomeric Compound
tgatcagctgcagtcctaac

SEQ ID NO: 88 - DNA, 20 bp, Artificial Sequence
  Oligomeric Compound
tgtataatgatgagcccctc

SEQ ID NO: 89 - DNA, 20 bp, Artificial Sequence
  Oligomeric Compound
gatcagcttgtccttggtca

SEQ ID NO: 90 - DNA, 20 bp, Artificial Sequence
  Oligomeric Compound
tctggtggttgatgtgatta

SEQ ID NO: 91 - DNA, 20 bp, Artificial Sequence
  Oligomeric Compound
tgagtgctctggtggttgat

SEQ ID NO: 92 - DNA, 20 bp, Artificial Sequence
  Oligomeric Compound
cagcatccaaatgtgagtgc

SEQ ID NO: 93 - DNA, 20 bp, Artificial Sequence
  Oligomeric Compound
gcttcacagcatccaaatgt

SEQ ID NO: 94 - DNA, 20 bp, Artificial Sequence
  Oligomeric Compound
gaaggcagtggaaagaagac

SEQ ID NO: 95 - DNA, 20 bp, Artificial Sequence
  Oligomeric Compound
agagaaggcaaggctgcctt

SEQ ID NO: 96 - DNA, 20 bp, Artificial Sequence
  Oligomeric Compound
ggtttgttagagaaggcaag

SEQ ID NO: 97 - DNA, 20 bp, Artificial Sequence
  Oligomeric Compound
acatcatgcagtttgaggta

SEQ ID NO: 98 - DNA, 20 bp, Artificial Sequence
  Oligomeric Compound
gctttcaggacatcatgcag

SEQ ID NO: 99 - DNA, 20 bp, Artificial Sequence
  Oligomeric Compound
aagcaggatttcaggtatcc

SEQ ID NO: 100 - DNA, 20 bp, Artificial Sequence
  Oligomeric Compound
ctcgactaaagcaggatttc

SEQ ID NO: 101 - DNA, 20 bp, Artificial Sequence
  Oligomeric Compound
acagttgccatcattggttc

SEQ ID NO: 102 - DNA, 20 bp, Artificial Sequence
  Oligomeric Compound
attgttgaacacaaacagtt

SEQ ID NO: 103 - DNA, 20 bp, Artificial Sequence
  Oligomeric Compound
ttggaagataagccatcaaa

SEQ ID NO: 104 - DNA, 20 bp, Artificial Sequence
  Oligomeric Compound
tgcaccatgttcctcaggct

SEQ ID NO: 105 - DNA, 20 bp, Artificial Sequence
  Oligomeric Compound
cgcctgcaccatgttcctca

SEQ ID NO: 106 - DNA, 20 bp, Artificial Sequence
  Oligomeric Compound
aatagcattcttatctgcac

SEQ ID NO: 107 - DNA, 20 bp, Artificial Sequence
  Oligomeric Compound
aatgtgattatgaatagcat

SEQ ID NO: 108 - DNA, 20 bp, Artificial Sequence
  Oligomeric Compound
taactgcacacatgttgtag

SEQ ID NO: 109 - DNA, 20 bp, Artificial Sequence
  Oligomeric Compound
aacacctgatctgaatccag

SEQ ID NO: 110 - DNA, 20 bp, Artificial Sequence
  Oligomeric Compound
gtttcaatacaaagccaata

SEQ ID NO: 111 - DNA, 20 bp, Artificial Sequence
  Oligomeric Compound
aactggcccacttcaatgta

SEQ ID NO: 112 - DNA, 20 bp, Artificial Sequence
  Oligomeric Compound
tgattccctgaactggccca

SEQ ID NO: 113 - DNA, 20 bp, Artificial Sequence
  Oligomeric Compound
ttaggaattccaatgatctg

SEQ ID NO: 114 - DNA, 20 bp, Artificial Sequence
  Oligomeric Compound
atgattttaggaattccaat

SEQ ID NO: 115 - DNA, 20 bp, Artificial Sequence
  Oligomeric Compound
ctggccatgatgccatcaca

SEQ ID NO: 116 - DNA, 20 bp, Artificial Sequence
  Oligomeric Compound
ttccttccactggccatgat

SEQ ID NO: 117 - DNA, 20 bp, Artificial Sequence
  Oligomeric Compound
gcatcagctttatttgttcc

SEQ ID NO: 118 - DNA, 20 bp, Artificial Sequence
  Oligomeric Compound
ctcagtaacattgacaccac

SEQ ID NO: 119 - DNA, 20 bp, Artificial Sequence
  Oligomeric Compound
tactggatgagtctcagtaa

SEQ ID NO: 120 - DNA, 20 bp, Artificial Sequence
  Oligomeric Compound
ctgatggtactggatgagtc

SEQ ID NO: 121 - DNA, 20 bp, Artificial Sequence
  Oligomeric Compound
tggcactgctgcaggacaag

SEQ ID NO: 122 - DNA, 20 bp, Artificial Sequence
  Oligomeric Compound
tcctgaatacgagaaagaac

SEQ ID NO: 123 - DNA, 20 bp, Artificial Sequence
  Oligomeric Compound
tttggctgccaagtcagaat

SEQ ID NO: 124 - DNA, 20 bp, Artificial Sequence
  Oligomeric Compound
tccaagtttggctgccaagt

SEQ ID NO: 125 - DNA, 20 bp, Artificial Sequence
  Oligomeric Compound
tctctattgcacattccaag

SEQ ID NO: 126 - DNA, 20 bp, Artificial Sequence
  Oligomeric Compound
ctgacagacataatcacaga

SEQ ID NO: 127 - DNA, 20 bp, Artificial Sequence
  Oligomeric Compound
tgatcagatcttgaatgtga

SEQ ID NO: 128 - DNA, 20 bp, Artificial Sequence
  Oligomeric Compound
cgagactgaattgcctggat

SEQ ID NO: 129 - DNA, 20 bp, Artificial Sequence
  Oligomeric Compound
gaatagagcctttggtgtct

SEQ ID NO: 130 - DNA, 20 bp, Artificial Sequence
  Oligomeric Compound
gtcttgcatggtggagagac

SEQ ID NO: 131 - DNA, 20 bp, Artificial Sequence
  Oligomeric Compound
aatctgacctggtccaacac

SEQ ID NO: 132 - DNA, 20 bp, Artificial Sequence
  Oligomeric Compound
agcagtgcagaatctgacct

SEQ ID NO: 133 - DNA, 20 bp, Artificial Sequence
  Oligomeric Compound
tctgcaccttccagcagtgc

SEQ ID NO: 134 - DNA, 20 bp, Artificial Sequence
  Oligomeric Compound
accagaaatttcactcatcc

SEQ ID NO: 135 - DNA, 20 bp, Artificial Sequence
  Oligomeric Compound
ctggccaccagaaatttcac

SEQ ID NO: 136 - DNA, 20 bp, Artificial Sequence
  Oligomeric Compound
cagcatccccaaacagatca

SEQ ID NO: 137 - DNA, 20 bp, Artificial Sequence
  Oligomeric Compound
acagtgcagcatccccaaac

SEQ ID NO: 138 - DNA, 20 bp, Artificial Sequence
  Oligomeric Compound
ggactgatacagtgcagcat

SEQ ID NO: 139 - DNA, 20 bp, Artificial Sequence
  Oligomeric Compound
ttctcaggaggaaggtgcaa

SEQ ID NO: 140 - DNA, 20 bp, Artificial Sequence
  Oligomeric Compound
ctgctcatggatcaaatgcc

SEQ ID NO: 141 - DNA, 20 bp, Artificial Sequence
  Oligomeric Compound
gtgtgtttggatctacttcc

SEQ ID NO: 142 - DNA, 20 bp, Artificial Sequence
  Oligomeric Compound
gcagtgatatacttaggatt

SEQ ID NO: 143 - DNA, 20 bp, Artificial Sequence
  Oligomeric Compound
tcacaggctgcagtgatata

SEQ ID NO: 144 - DNA, 20 bp, Artificial Sequence
  Oligomeric Compound
tgatgttcctgagcaatggc

SEQ ID NO: 145 - DNA, 20 bp, Artificial Sequence
  Oligomeric Compound
tccaagcttccacaccagtg

SEQ ID NO: 146 - DNA, 20 bp, Artificial Sequence
  Oligomeric Compound
tgttgatgcggtagatgaac

SEQ ID NO: 147 - DNA, 20 bp, Artificial Sequence
  Oligomeric Compound
gtcaccaggacaccaaggag

SEQ ID NO: 148 - DNA, 20 bp, Artificial Sequence
  Oligomeric Compound
tccaagcagcttacagctgg

SEQ ID NO: 149 - DNA, 20 bp, Artificial Sequence
  Oligomeric Compound
ttgaaaccattgcttgaatc

SEQ ID NO: 150 - DNA, 20 bp, Artificial Sequence
  Oligomeric Compound
atgcctgatataaatgatgg

SEQ ID NO: 151 - DNA, 20 bp, Artificial Sequence
  Oligomeric Compound
gttgatctgcagcagcagct

SEQ ID NO: 152 - DNA, 20 bp, Artificial Sequence
  Oligomeric Compound
gagtgtatggacacctggcc

SEQ ID NO: 153 - DNA, 20 bp, Artificial Sequence
  Oligomeric Compound
tgttccccagccacacggag

SEQ ID NO: 154 - DNA, 20 bp, Artificial Sequence
  Oligomeric Compound
gtggcaggcaccaggtactg

SEQ ID NO: 155 - DNA, 20 bp, Artificial Sequence
  Oligomeric Compound
atagttctcaatgaggtaaa

SEQ ID NO: 156 - DNA, 20 bp, Artificial Sequence
  Oligomeric Compound
acagtggtaaatgatggagg

SEQ ID NO: 157 - DNA, 20 bp, Artificial Sequence
  Oligomeric Compound
atgcaggtgagcatcaggcc

SEQ ID NO: 158 - DNA, 20 bp, Artificial Sequence
  Oligomeric Compound
tgtgtacatgcaggtgagca

SEQ ID NO: 159 - DNA, 20 bp, Artificial Sequence
  Oligomeric Compound
aggaaagcctttcctgatcc

SEQ ID NO: 160 - DNA, 20 bp, Artificial Sequence
  Oligomeric Compound
tatggctgctggttggacag

SEQ ID NO: 161 - DNA, 20 bp, Artificial Sequence
  Oligomeric Compound
cagcatgacccagtcccgga

SEQ ID NO: 162 - DNA, 20 bp, Artificial Sequence
  Oligomeric Compound
ggacagcatgacccagtccc

SEQ ID NO: 163 - DNA, 20 bp, Artificial Sequence
  Oligomeric Compound
cccatcctgctgatgacatg

SEQ ID NO: 164 - DNA, 20 bp, Artificial Sequence
  Oligomeric Compound
accaggcagaaaaggttcac

SEQ ID NO: 165 - DNA, 20 bp, Artificial Sequence
  Oligomeric Compound
tcagcaggtggtgaccttgt

SEQ ID NO: 166 - DNA, 20 bp, Artificial Sequence
  Oligomeric Compound
tctgccacatggcagagaca

SEQ ID NO: 167 - DNA, 20 bp, Artificial Sequence
  Oligomeric Compound
aaagagcacttctgccacat

SEQ ID NO: 168 - DNA, 20 bp, Artificial Sequence
  Oligomeric Compound
gccactgccacaaagagcac

SEQ ID NO: 169 - DNA, 20 bp, Artificial Sequence
  Oligomeric Compound
caccaggactgcagacactc

SEQ ID NO: 170 - DNA, 20 bp, Artificial Sequence
  Oligomeric Compound
tggaaggcctcaggctcagc

SEQ ID NO: 171 - DNA, 20 bp, Artificial Sequence
  Oligomeric Compound
ggacctggtcacccacatgg

SEQ ID NO: 172 - DNA, 20 bp, Artificial Sequence
  Oligomeric Compound
ggcaacaaccagcaggtgac

SEQ ID NO: 173 - DNA, 20 bp, Artificial Sequence
  Oligomeric Compound
tgcaacctggcaacaaccag

SEQ ID NO: 174 - DNA, 20 bp, Artificial Sequence
  Oligomeric Compound
cccagatgcaagagcagctg

SEQ ID NO: 175 - DNA, 20 bp, Artificial Sequence
  Oligomeric Compound
aacagccagcctgcaggagg

SEQ ID NO: 176 - DNA, 20 bp, Artificial Sequence
  Oligomeric Compound
tctactgcaggacagcagag

SEQ ID NO: 177 - DNA, 20 bp, Artificial Sequence
  Oligomeric Compound
tgttcccaaagcctgctcac

SEQ ID NO: 178 - DNA, 20 bp, Artificial Sequence
  Oligomeric Compound
ccaggccagtgttcccaaag

SEQ ID NO: 179 - DNA, 20 bp, Artificial Sequence
  Oligomeric Compound
ggagacccaggccagtgttc

SEQ ID NO: 180 - DNA, 20 bp, Artificial Sequence
  Oligomeric Compound
agcacaggccatggcatctg

SEQ ID NO: 181 - DNA, 20 bp, Artificial Sequence
  Oligomeric Compound
ctggcccagcacaggccatg

SEQ ID NO: 182 - DNA, 20 bp, Artificial Sequence
  Oligomeric Compound
actgatataattaaatttta

SEQ ID NO: 183 - DNA, 20 bp, Artificial Sequence
  Oligomeric Compound
ggctatgccagtggctacag

SEQ ID NO: 184 - DNA, 20 bp, Artificial Sequence
  Oligomeric Compound
tgtgaatgcataaacaggaa

SEQ ID NO: 185 - DNA, 20 bp, Artificial Sequence
  Oligomeric Compound
ctagcaaggaacaggagtgg

SEQ ID NO: 186 - DNA, 20 bp, Artificial Sequence
  Oligomeric Compound
ccatggagcagcaggtccca

SEQ ID NO: 187 - DNA, 20 bp, Artificial Sequence
  Oligomeric Compound
gcatgcatccatggagcagc

SEQ ID NO: 188 - DNA, 20 bp, Artificial Sequence
  Oligomeric Compound
actaacagtgccaagacacc

SEQ ID NO: 189 - DNA, 20 bp, Artificial Sequence
  Oligomeric Compound
ccattttaatgacttggctc

SEQ ID NO: 190 - DNA, 20 bp, Artificial Sequence
  Oligomeric Compound
aggaagcagagcccctgcct

SEQ ID NO: 191 - DNA, 20 bp, Artificial Sequence
  Oligomeric Compound
ggcagcacctgcacagagtt

SEQ ID NO: 192 - DNA, 20 bp, Artificial Sequence
  Oligomeric Compound
gcatacaagtccacatctca

SEQ ID NO: 193 - DNA, 20 bp, Artificial Sequence
  Oligomeric Compound
catacaggcctggcagaggc

SEQ ID NO: 194 - DNA, 20 bp, Artificial Sequence
  Oligomeric Compound
aagaatggtgattttcttac

SEQ ID NO: 195 - DNA, 20 bp, Artificial Sequence
  Oligomeric Compound
tctagccaggaacaacatct

SEQ ID NO: 196 - DNA, 20 bp, Artificial Sequence
  Oligomeric Compound
atgtaaacatctagccagga

SEQ ID NO: 197 - DNA, 20 bp, Artificial Sequence
  Oligomeric Compound
aatgagctcatattcatctc

SEQ ID NO: 198 - DNA, 20 bp, Artificial Sequence
  Oligomeric Compound
gaatgagccctgccctgacc

SEQ ID NO: 199 - DNA, 20 bp, Artificial Sequence
  Oligomeric Compound
gcaatgaatgagccctgccc

SEQ ID NO: 200 - DNA, 20 bp, Artificial Sequence
  Oligomeric Compound
agctgatatggagaccatct

SEQ ID NO: 201 - DNA, 20 bp, Artificial Sequence
  Oligomeric Compound
ggtgcttgccacagattttt

SEQ ID NO: 202 - DNA, 20 bp, Artificial Sequence
  Oligomeric Compound
tgcattgccaaacaattcta

SEQ ID NO: 203 - DNA, 20 bp, Artificial Sequence
  Oligomeric Compound
ttggcagctggaaacatcac

SEQ ID NO: 204 - DNA, 20 bp, Artificial Sequence
  Oligomeric Compound
tccaagtctaccctggccag

SEQ ID NO: 205 - DNA, 20 bp, Artificial Sequence
  Oligomeric Compound
gttgccttcagttgtcatgc

SEQ ID NO: 206 - DNA, 20 bp, Artificial Sequence
  Oligomeric Compound
ttccaggttgccttcagttg

SEQ ID NO: 207 - DNA, 20 bp, Artificial Sequence
  Oligomeric Compound
cagttaccacccagattgca

SEQ ID NO: 208 - DNA, 20 bp, Artificial Sequence
  Oligomeric Compound
gagacctggacaaggaggcc

SEQ ID NO: 209 - DNA, 20 bp, Artificial Sequence
  Oligomeric Compound
tgtaattacagaatttgtat

SEQ ID NO: 210 - DNA, 20 bp, Artificial Sequence
  Oligomeric Compound
acattccatgaattccattt

SEQ ID NO: 211 - DNA, 20 bp, Artificial Sequence
  Oligomeric Compound
gttaatttagagaaaattca

SEQ ID NO: 212 - DNA, 20 bp, Artificial Sequence
  Oligomeric Compound
cagaagcatccaaaccagta

SEQ ID NO: 213 - DNA, 20 bp, Artificial Sequence
  Oligomeric Compound
caagagggttgcatagaaac

SEQ ID NO: 214 - DNA, 20 bp, Artificial Sequence
  Oligomeric Compound
caaagtataaacagtttgag

SEQ ID NO: 215 - DNA, 20 bp, Artificial Sequence
  Oligomeric Compound
cccagtgcagttcacattca

SEQ ID NO: 216 - DNA, 20 bp, Artificial Sequence
  Oligomeric Compound
tattataaaatacatgtttc

SEQ ID NO: 217 - DNA, 20 bp, Artificial Sequence
  Oligomeric Compound
attagagattcatcatattg

SEQ ID NO: 218 - DNA, 20 bp, Artificial Sequence
  Oligomeric Compound
ggtatggaaaggttcaacat

SEQ ID NO: 219 - DNA, 20 bp, Artificial Sequence
  Oligomeric Compound
tggaaggtgagggacaaaaa

SEQ ID NO: 220 - DNA, 20 bp, Artificial Sequence
  Oligomeric Compound
agcagaaacaagtattccat

SEQ ID NO: 221 - DNA, 20 bp, Artificial Sequence
  Oligomeric Compound
caaattcacatagggttggt

SEQ ID NO: 222 - DNA, 20 bp, Artificial Sequence
  Oligomeric Compound
acatgagcaatgaaggacag

SEQ ID NO: 223 - DNA, 20 bp, Artificial Sequence
  Oligomeric Compound
gcaatgtgtgatttaccaca

SEQ ID NO: 224 - DNA, 20 bp, Artificial Sequence
  Oligomeric Compound
accacatcataatttgtcat

SEQ ID NO: 225 - DNA, 20 bp, Artificial Sequence
  Oligomeric Compound
attatttaagaagtacccac

SEQ ID NO: 226 - DNA, 20 bp, Artificial Sequence
  Oligomeric Compound
tgccccaaaaagtggaacca

SEQ ID NO: 227 - DNA, 20 bp, Artificial Sequence
  Oligomeric Compound
acatttccaagaggttttga

SEQ ID NO: 228 - DNA, 20 bp, Artificial Sequence
  Oligomeric Compound
tcagccccaatttgtagcag

SEQ ID NO: 229 - DNA, 20 bp, Artificial Sequence
  Oligomeric Compound
gacataaagtttagaggtat

SEQ ID NO: 230 - DNA, 20 bp, Artificial Sequence
  Oligomeric Compound
gaaggacccacagaggtttg

SEQ ID NO: 231 - DNA, 20 bp, Artificial Sequence
  Oligomeric Compound
tgaaaaggaagtgacatcat

SEQ ID NO: 232 - DNA, 20 bp, Artificial Sequence
  Oligomeric Compound
cagtgtcaggagaagcccag

SEQ ID NO: 233 - DNA, 20 bp, Artificial Sequence
  Oligomeric Compound
gataaaacaccttgttaatg

SEQ ID NO: 234 - DNA, 20 bp, Artificial Sequence
  Oligomeric Compound
ggagcagtaccttatagttg

SEQ ID NO: 235 - DNA, 20 bp, Artificial Sequence
  Oligomeric Compound
atagctgctgcacacagaca

SEQ ID NO: 236 - DNA, 20 bp, Artificial Sequence
  Oligomeric Compound
gcatcagtacctgaactggc

SEQ ID NO: 237 - DNA, 20 bp, Artificial Sequence
  Oligomeric Compound
gagtggttggctaatgttga

SEQ ID NO: 238 - DNA, 20 bp, Artificial Sequence
  Oligomeric Compound
cagttttgtcctggatacaa

SEQ ID NO: 239 - DNA, 20 bp, Artificial Sequence
  Oligomeric Compound
ggagccagttgtagaagtac

SEQ ID NO: 240 - DNA, 20 bp, Artificial Sequence
  Oligomeric Compound
cctggtgtggtcagtgcttg

SEQ ID NO: 241 - DNA, 20 bp, Artificial Sequence
  Oligomeric Compound
cagagtgagctgcccaagcc

SEQ ID NO: 242 - DNA, 20 bp, Artificial Sequence
  Oligomeric Compound
tcttcttgaaccagagtgag

SEQ ID NO: 243 - DNA, 20 bp, Artificial Sequence
  Oligomeric Compound
gtttctgaaaacatctgaga

SEQ ID NO: 244 - DNA, 20 bp, Artificial Sequence
  Oligomeric Compound
ctatggcccattctttccaa

SEQ ID NO: 245 - DNA, 20 bp, Artificial Sequence
  Oligomeric Compound
taagcagttgtaatcccaag

SEQ ID NO: 246 - DNA, 20 bp, Artificial Sequence
  Oligomeric Compound
ggactcattggagtagaagc

SEQ ID NO: 247 - DNA, 20 bp, Artificial Sequence
  Oligomeric Compound
aagaccactagctgcagaat

SEQ ID NO: 248 - DNA, 20 bp, Artificial Sequence
  Oligomeric Compound
tggtatgatgtggtatcacc

SEQ ID NO: 249 - DNA, 20 bp, Artificial Sequence
  Oligomeric Compound
gtcattaccacaaacttcac

SEQ ID NO: 250 - DNA, 20 bp, Artificial Sequence
  Oligomeric Compound
gactgaggttttgtatatct

SEQ ID NO: 251 - DNA, 20 bp, Artificial Sequence
  Oligomeric Compound
acaatgttcttcagcacagc

SEQ ID NO: 252 - DNA, 20 bp, Artificial Sequence
  Oligomeric Compound
cagcagatagtcactaacaa

SEQ ID NO: 253 - DNA, 20 bp, Artificial Sequence
  Oligomeric Compound
actggagttctttgtgtgaa

SEQ ID NO: 254 - DNA, 20 bp, Artificial Sequence
  Oligomeric Compound
ggcactactcagcaggtggt

SEQ ID NO: 255 - DNA, 20 bp, Artificial Sequence
  Oligomeric Compound
cttttgtcccacaggcacta

SEQ ID NO: 256 - DNA, 20 bp, Artificial Sequence
  Oligomeric Compound
cttgacacaagtggaagcct

SEQ ID NO: 257 - DNA, 20 bp, Artificial Sequence
  Oligomeric Compound
gcatagccctcattgcaaag

SEQ ID NO: 258 - DNA, 20 bp, Artificial Sequence
  Oligomeric Compound
tagtgcatgttccctgcata

SEQ ID NO: 259 - DNA, 20 bp, Artificial Sequence
  Oligomeric Compound
aaccccaacatagtgcatgt

SEQ ID NO: 260 - DNA, 20 bp, Artificial Sequence
  Oligomeric Compound
aagacaaacacctggtcaac

SEQ ID NO: 261 - DNA, 20 bp, Artificial Sequence
  Oligomeric Compound
aaccatctggcaagagctag

SEQ ID NO: 262 - DNA, 20 bp, Artificial Sequence
  Oligomeric Compound
tgtggcaggtatgcctactg

SEQ ID NO: 263 - DNA, 20 bp, Artificial Sequence
  Oligomeric Compound
gacactggtgtggcaggtat

SEQ ID NO: 264 - DNA, 20 bp, Artificial Sequence
  Oligomeric Compound
cttgccaagtcacacacttt

SEQ ID NO: 265 - DNA, 20 bp, Artificial Sequence
  Oligomeric Compound
acttccataaactttgtcac

SEQ ID NO: 266 - DNA, 20 bp, Artificial Sequence
  Oligomeric Compound
gactgagtagctacaggaga

SEQ ID NO: 267 - DNA, 20 bp, Artificial Sequence
  Oligomeric Compound
tgctggcttaatggaatgca

SEQ ID NO: 268 - DNA, 20 bp, Artificial Sequence
  Oligomeric Compound
ggattctcacacaggcagtc

SEQ ID NO: 269 - DNA, 20 bp, Artificial Sequence
  Oligomeric Compound
gttaggccacaggcaggatt

SEQ ID NO: 270 - DNA, 20 bp, Artificial Sequence
  Oligomeric Compound
cagtttttcagttcctcagt

SEQ ID NO: 271 - DNA, 20 bp, Artificial Sequence
  Oligomeric Compound
ttataactctaacagtggaa

SEQ ID NO: 272 - DNA, 20 bp, Artificial Sequence
  Oligomeric Compound
ctaggagagtgcatcaacac

SEQ ID NO: 273 - DNA, 20 bp, Artificial Sequence
  Oligomeric Compound
tttctacccaggctgagaga

SEQ ID NO: 274 - DNA, 20 bp, Artificial Sequence
  Oligomeric Compound
ctacagtgcaggtcagccac

SEQ ID NO: 275 - DNA, 20 bp, Artificial Sequence
  Oligomeric Compound
catccacaatggtcagctgg

SEQ ID NO: 276 - DNA, 20 bp, Artificial Sequence
  Oligomeric Compound
cccaaccatgcagaagatac

SEQ ID NO: 277 - DNA, 20 bp, Artificial Sequence
  Oligomeric Compound
ggtcagcacttctcaggtcc

SEQ ID NO: 278 - DNA, 20 bp, Artificial Sequence
  Oligomeric Compound
ttaacatgacctggttactc

SEQ ID NO: 279 - DNA, 20 bp, Artificial Sequence
  Oligomeric Compound
cccaaaccaagccaggaaat

SEQ ID NO: 280 - DNA, 20 bp, Artificial Sequence
  Oligomeric Compound
cttggtcatatagtcaaaca

SEQ ID NO: 281 - DNA, 20 bp, Artificial Sequence
  Oligomeric Compound
taatcacaggctgcaagctc

SEQ ID NO: 282 - DNA, 20 bp, Artificial Sequence
  Oligomeric Compound
aagcaatccatggactgaag

SEQ ID NO: 283 - DNA, 20 bp, Artificial Sequence
  Oligomeric Compound
gtcatgatggaaagatagag

SEQ ID NO: 284 - DNA, 20 bp, Artificial Sequence
  Oligomeric Compound
aaccttgcatcccagcagca

SEQ ID NO: 285 - DNA, 20 bp, Artificial Sequence
  Oligomeric Compound
ggcagataggaggagagtca

SEQ ID NO: 286 - DNA, 20 bp, Artificial Sequence
  Oligomeric Compound
ggtgaatttctttcattaaa

SEQ ID NO: 287 - DNA, 20 bp, Artificial Sequence
  Oligomeric Compound
ttggaccaacctcagagtgt

SEQ ID NO: 288 - DNA, 20 bp, Artificial Sequence
  Oligomeric Compound
gtaatcaggcctgcaccatg

SEQ ID NO: 289 - DNA, 20 bp, Artificial Sequence
  Oligomeric Compound
catctaccatgaggagtaat

SEQ ID NO: 290 - DNA, 20 bp, Artificial Sequence
  Oligomeric Compound
aatggctctagattttatat

SEQ ID NO: 291 - DNA, 20 bp, Artificial Sequence
  Oligomeric Compound
ttctgatcacactaaacaag

SEQ ID NO: 292 - DNA, 20 bp, Artificial Sequence
  Oligomeric Compound
ctaggttgtggcacccatga

SEQ ID NO: 293 - DNA, 20 bp, Artificial Sequence
  Oligomeric Compound
gtacccaggtgcatctctag

SEQ ID NO: 294 - DNA, 20 bp, Artificial Sequence
  Oligomeric Compound
tgtatgtggcagttgcaaga

SEQ ID NO: 295 - DNA, 20 bp, Artificial Sequence
  Oligomeric Compound
acttttaaaaattgagtccc

SEQ ID NO: 296 - DNA, 20 bp, Artificial Sequence
  Oligomeric Compound
ttaaataaagcttggaaatc

SEQ ID NO: 297 - DNA, 20 bp, Artificial Sequence
  Oligomeric Compound
tgacagtaccaccatggaaa

SEQ ID NO: 298 - DNA, 20 bp, Artificial Sequence
  Oligomeric Compound
gtgcattgccaaaagttcta

SEQ ID NO: 299 - DNA, 20 bp, Artificial Sequence
  Oligomeric Compound
aagtcacctacatgtcaagg

SEQ ID NO: 300 - DNA, 20 bp, Artificial Sequence
  Oligomeric Compound
acttggcagtggctaagtca

SEQ ID NO: 301 - DNA, 20 bp, Artificial Sequence
  Oligomeric Compound
gttaggattggtcccttccc

SEQ ID NO: 302 - DNA, 20 bp, Artificial Sequence
  Oligomeric Compound
gaccaattctgcagccccac

SEQ ID NO: 303 - DNA, 20 bp, Artificial Sequence
  Oligomeric Compound
ccatgatcctagtgctcaat

SEQ ID NO: 304 - DNA, 20 bp, Artificial Sequence
  Oligomeric Compound
ccacataccaatccctggag

SEQ ID NO: 305 - DNA, 20 bp, Artificial Sequence
  Oligomeric Compound
ccagcatcagcagctcagtg

SEQ ID NO: 306 - DNA, 20 bp, Artificial Sequence
  Oligomeric Compound
tttcccaaccatgatatcct

SEQ ID NO: 307 - DNA, 20 bp, Artificial Sequence
  Oligomeric Compound
ccctgaaccttgatatcatc

SEQ ID NO: 308 - DNA, 20 bp, Artificial Sequence
  Oligomeric Compound
tgcagataggtctctgccac

SEQ ID NO: 309 - DNA, 20 bp, Artificial Sequence
  Oligomeric Compound
tacagcagcaaggcttggac

SEQ ID NO: 310 - DNA, 20 bp, Artificial Sequence
  Oligomeric Compound
ggaaatggacagccaggtct

SEQ ID NO: 311 - DNA, 20 bp, Artificial Sequence
  Oligomeric Compound
aggttctgcctcacacagca

SEQ ID NO: 312 - DNA, 20 bp, Artificial Sequence
  Oligomeric Compound
cccgcaggttctgcctcaca

SEQ ID NO: 313 - DNA, 20 bp, Artificial Sequence
  Oligomeric Compound
agggaaccagcccgcccctg

SEQ ID NO: 314 - DNA, 20 bp, Artificial Sequence
  Oligomeric Compound
tggccagggaaccagcccgc

SEQ ID NO: 315 - DNA, 20 bp, Artificial Sequence
  Oligomeric Compound
atggctggccagggaaccag

SEQ ID NO: 316 - DNA, 20 bp, Artificial Sequence
  Oligomeric Compound
tgccaatggctggccaggga

SEQ ID NO: 317 - DNA, 20 bp, Artificial Sequence
  Oligomeric Compound
gacagccctagcctgcggac

SEQ ID NO: 318 - DNA, 20 bp, Artificial Sequence
  Oligomeric Compound
gattgacagccctagcctgc

SEQ ID NO: 319 - DNA, 20 bp, Artificial Sequence
  Oligomeric Compound
gcatgattgacagccctagc

SEQ ID NO: 320 - DNA, 20 bp, Artificial Sequence
  Oligomeric Compound
atcttggacccgtcccggca

SEQ ID NO: 321 - DNA, 20 bp, Artificial Sequence
  Oligomeric Compound
cgtccatcttggacccgtcc

SEQ ID NO: 322 - DNA, 20 bp, Artificial Sequence
  Oligomeric Compound
agcggccgtccatcttggac

SEQ ID NO: 323 - DNA, 20 bp, Artificial Sequence
  Oligomeric Compound
aacctgagcggccgtccatc

SEQ ID NO: 324 - DNA, 20 bp, Artificial Sequence
  Oligomeric Compound
gcagaacctgagcggccgtc

SEQ ID NO: 325 - DNA, 20 bp, Artificial Sequence
  Oligomeric Compound
aaaagcagaacctgagcggc

SEQ ID NO: 326 - DNA, 20 bp, Artificial Sequence
  Oligomeric Compound
ggtaaaagcagaacctgagc

SEQ ID NO: 327 - DNA, 20 bp, Artificial Sequence
  Oligomeric Compound
ggccgcaggtaaaagcagaa

SEQ ID NO: 328 - DNA, 20 bp, Artificial Sequence
  Oligomeric Compound
gctctgggccgcaggtaaaa

SEQ ID NO: 329 - DNA, 20 bp, Artificial Sequence
  Oligomeric Compound
agtccccggaggcctcgggc

SEQ ID NO: 330 - DNA, 20 bp, Artificial Sequence
  Oligomeric Compound
ggcacggcagtccccggagg

SEQ ID NO: 331 - DNA, 20 bp, Artificial Sequence
  Oligomeric Compound
agggtcgccatggcggtctc

SEQ ID NO: 332 - DNA, 20 bp, Artificial Sequence
  Oligomeric Compound
ttttccagggtcgccatggc

SEQ ID NO: 333 - DNA, 20 bp, Artificial Sequence
  Oligomeric Compound
tcagcttttccagggtcgcc

SEQ ID NO: 334 - DNA, 20 bp, Artificial Sequence
  Oligomeric Compound
ttcatcagcttttccagggt

SEQ ID NO: 335 - DNA, 20 bp, Artificial Sequence
  Oligomeric Compound
aaggccttcatcagcttttc

SEQ ID NO: 336 - DNA, 20 bp, Artificial Sequence
  Oligomeric Compound
actcgaaggccttcatcagc

SEQ ID NO: 337 - DNA, 20 bp, Artificial Sequence
  Oligomeric Compound
gagggactcgaaggccttca

SEQ ID NO: 338 - DNA, 20 bp, Artificial Sequence
  Oligomeric Compound
ggacttgagggactcgaagg

SEQ ID NO: 339 - DNA, 20 bp, Artificial Sequence
  Oligomeric Compound
ctgaggaagctgaggaggcg

SEQ ID NO: 340 - DNA, 20 bp, Artificial Sequence
  Oligomeric Compound
tgtgcctgcggcggcggctg

SEQ ID NO: 341 - DNA, 20 bp, Artificial Sequence
  Oligomeric Compound
ggcagcagcggctgtgcctg

SEQ ID NO: 342 - DNA, 20 bp, Artificial Sequence
  Oligomeric Compound
caaactcacggtcggtgcag

SEQ ID NO: 343 - DNA, 20 bp, Artificial Sequence
  Oligomeric Compound
gcgggcccaaactcacggtc

SEQ ID NO: 344 - DNA, 20 bp, Artificial Sequence
  Oligomeric Compound
ggagctgcagcgggcccaaa

SEQ ID NO: 345 - DNA, 20 bp, Artificial Sequence
  Oligomeric Compound
gccgtagcctgggacccgcc

SEQ ID NO: 346 - DNA, 20 bp, Artificial Sequence
  Oligomeric Compound
gcagggttaccgccatcccc

SEQ ID NO: 347 - DNA, 20 bp, Artificial Sequence
  Oligomeric Compound
aggctgcagggttaccgcca

SEQ ID NO: 348 - DNA, 20 bp, Artificial Sequence
  Oligomeric Compound
cccgcaggctgcagggttac

SEQ ID NO: 349 - DNA, 20 bp, Artificial Sequence
  Oligomeric Compound
gccggcccgcaggctgcagg

SEQ ID NO: 350 - DNA, 20 bp, Artificial Sequence
  Oligomeric Compound
aaggcctcgccccaggaggg

SEQ ID NO: 351 - DNA, 20 bp, Artificial Sequence
  Oligomeric Compound
agacccaagtgagggagcgg

SEQ ID NO: 352 - DNA, 20 bp, Artificial Sequence
  Oligomeric Compound
aagggaagacccaagtgagg

SEQ ID NO: 353 - DNA, 20 bp, Artificial Sequence
  Oligomeric Compound
ggacaagggaagacccaagt

SEQ ID NO: 354 - DNA, 20 bp, Artificial Sequence
  Oligomeric Compound
tcgcgagaggacaagggaag

SEQ ID NO: 355 - DNA, 20 bp, Artificial Sequence
  Oligomeric Compound
tcccctcgcgagaggacaag

SEQ ID NO: 356 - DNA, 20 bp, Artificial Sequence
  Oligomeric Compound
ggccccaacaaggctctgcc

SEQ ID NO: 357 - DNA, 20 bp, Artificial Sequence
  Oligomeric Compound
ggacaggccccaacaaggct

SEQ ID NO: 358 - DNA, 20 bp, Artificial Sequence
  Oligomeric Compound
  misc_feature 3: n = A or T
cgnctgcaccatgttcctca

SEQ ID NO: 359 - DNA, 20 bp, Artificial Sequence
  Oligomeric Compound
  misc_feature 5: n = C or G
cgccngcaccatgttcctca

SEQ ID NO: 360 - DNA, 20 bp, Artificial Sequence
  Oligomeric Compound
  misc_feature 12: n = C or G
cgcctgcaccangttcctca

SEQ ID NO: 361 - DNA, 20 bp, Artificial Sequence
  Oligomeric Compound
  misc_feature 17: n = A or T
cgcctgcaccatgttcntca

SEQ ID NO: 362 - DNA, 20 bp, Artificial Sequence
  Oligomeric Compound
  misc_feature 3: n = A or T
gcngtagcctgggacccgcc

SEQ ID NO: 363 - DNA, 20 bp, Artificial Sequence
  Oligomeric Compound
  misc_feature 9, 14: n = C or G
gccgtagcntgggncccgcc

SEQ ID NO: 364 - DNA, 20 bp, Artificial Sequence
  Oligomeric Compound
  misc_feature 18: n = A or T
gccgtagcctgggacccncc

SEQ ID NO: 365 - DNA, 20 bp, Artificial Sequence
  Oligomeric Compound
  misc_feature 20: n = A or T
gccgtagcctgggacccgcn

SEQ ID NO: 366 - DNA, 20 bp, Artificial Sequence
  Oligomeric Compound
  misc_feature 3: n = C or G
tcnctattgcacattccaag

SEQ ID NO: 367 - DNA, 20 bp, Artificial Sequence
  Oligomeric Compound
  misc_feature 8: n = C or G
tctctatngcacattccaag

SEQ ID NO: 368 - DNA, 20 bp, Artificial Sequence
  Oligomeric Compound
  misc_feature 12: n = A or T
tctctattgcanattccaag

SEQ ID NO: 369 - DNA, 20 bp, Artificial Sequence
  Oligomeric Compound
  misc_feature 17: n = A or T
tctctattgcacattcnaag

What is claimed is:

1. A compound comprising a modified oligonucleotide consisting of 20 to 35 linked nucleosides comprising all 20 nucleobases of SEQ ID NO: 118.

2. The compound of claim 1, consisting of a single-stranded modified oligonucleotide.

3. The compound of claim 1, wherein said modified oligonucleotide is at least 95% complementary to SEQ ID NO: 4.

4. The compound of claim 1, wherein said modified oligonucleotide is 100% complementary to SEQ ID NO: 4.

5. The compound of claim 2, wherein at least one internucleoside linkage of said modified oligonucleotide is a modified internucleoside linkage.

6. The compound of claim 5, wherein each modified internucleoside linkage is a phosphorothioate internucleoside linkage.

7. The compound of claim 2, wherein at least one nucleoside comprises a modified sugar.

8. The compound of claim 7, wherein at least one modified sugar is a bicyclic sugar.

9. The compound of claim 7, wherein at least one modified sugar comprises a 2'-O-methoxyethyl.

10. The compound of claim 2, wherein at least one nucleoside comprises a modified nucleobase.

11. The compound of claim 10, wherein the modified nucleobase is a 5-methylcytosine.

12. The compound of claim 1 compound comprising a modified oligonucleotide 20 to 35 linked nucleotides in length, wherein the modified oligonucleotide comprises:
   a gap segment consisting of linked deoxynucleosides;
   a 5' wing segment consisting of linked nucleosides;
   a 3' wing segment consisting of linked nucleosides;
   wherein the gap segment is positioned between the 5' wing segment and the 3' wing segment and wherein each nucleoside of each wing segment comprises a modified sugar.

13. The compound of claim 12, wherein the modified oligonucleotide comprises:
   a gap segment consisting of ten linked deoxynucleosides;
   a 5' wing segment consisting of five linked nucleosides;
   a 3' wing segment consisting of five linked nucleosides;
   wherein the gap segment is positioned between the 5' wing segment and the 3' wing segment, wherein each nucleoside of each wing segment comprises a 2'-O-methoxyethyl sugar; wherein each cytidine residue of the modified oligonucleotide is a 5-methylcytidine, and wherein each internucleoside linkage of said modified oligonucleotide is a phosphorothioate linkage.

14. The compound of claim 13, wherein the modified oligonucleotide consists of 20 linked nucleosides.

15. The compound of claim 1, wherein said modified oligonucleotide consists of 20 to 25 linked nucleosides.

16. The compound of claim 1, wherein said modified oligonucleotide consists of 20 to 23 linked nucleosides.

17. The compound of claim 1, wherein said modified oligonucleotide consists of 20 linked nucleosides.

18. The compound of claim 1, wherein said modified oligonucleotide consists of a nucleobase sequence of SEQ ID NO: 118.

19. The compound of claim 1, wherein said modified oligonucleotide consists of the nucleobase sequence of SEQ ID NO: 118 and comprises:
   a gap segment consisting of ten linked deoxynucleosides;
   a 5' wing segment consisting of five linked nucleosides;
   a 3' wing segment consisting of five linked nucleosides;
   wherein the gap segment is positioned between the 5' wing segment and the 3' wing segment, wherein each nucleoside of each wing segment comprises a 2'-O-methoxyethyl sugar, wherein each internucleoside linkage of said modified oligonucleotide is a phosphorothioate linkage, and wherein each cytidine residue of said modified oligonucleotide is a 5-methylcytidine.

20. A composition comprising a compound of claim 1 or a pharmaceutically acceptable salt thereof and a pharmaceutically acceptable carrier or diluent.

21. The compound of claim 1, wherein said modified oligonucleotide consists of a nucleobase sequence of SEQ ID NO: 118.

22. The composition of claim 20, wherein said modified oligonucleotide consists of the nucleobase sequence of SEQ ID NO: 118 and comprises:
   a gap segment consisting of ten linked deoxynucleosides;
   a 5' wing segment consisting of five linked nucleosides;
   a 3' wing segment consisting of five linked nucleosides;
   wherein the gap segment is positioned between the 5' wing segment and the 3' wing segment, wherein each nucleoside of each wing segment comprises a 2'-O-methoxyethyl sugar, wherein each internucleoside linkage of said modified oligonucleotide is a phosphorothioate linkage, and wherein each cytidine residue of said modified oligonucleotide is a 5-methylcytidine.

23. A compound comprising a modified oligonucleotide consisting of 20 to 35 linked nucleosides comprising an at least 20 consecutive nucleobase portion complementary to nucleotides 4856-4875 of SEQ ID NO: 4, wherein said modified oligonucleotide is at least 90% complementary to SEQ ID NO: 4.

* * * * *